US008142788B2

(12) United States Patent
Kim

(10) Patent No.: US 8,142,788 B2
(45) Date of Patent: Mar. 27, 2012

(54) PRRSV GP5 BASED COMPOSITIONS AND METHODS

(75) Inventor: Byoung-Kwan Kim, Mankato, MN (US)

(73) Assignee: MJ Biologics, Inc., Mankato, MN (US)

( * ) Notice: Subject to any disclaimer, the term of this patent is extended or adjusted under 35 U.S.C. 154(b) by 181 days.

(21) Appl. No.: 12/111,871

(22) Filed: Apr. 29, 2008

(65) Prior Publication Data

US 2009/0208520 A1 Aug. 20, 2009

Related U.S. Application Data

(60) Provisional application No. 60/915,049, filed on Apr. 30, 2007.

(51) Int. Cl.

| | |
|---|---|
| ***A61K 39/12*** | (2006.01) |
| ***A61K 39/00*** | (2006.01) |
| ***A61K 39/38*** | (2006.01) |
| ***C12Q 1/70*** | (2006.01) |

(52) U.S. Cl. ........................ 424/186.1; 424/184.1; 435/5

(58) Field of Classification Search ........................ None
See application file for complete search history.

(56) References Cited

U.S. PATENT DOCUMENTS

2008/0019912 A1 1/2008 Harris et al.

OTHER PUBLICATIONS

Faaberg, Hocker, Erdman, Harris, Nelson, Torremorell, and Plagemann. Neutralizing antibody responses of pigs infected with natural GP5 N-glycan mutants of porcine reproductive and respiratory syndrome virus. Viral Immunology, 2006. vol. 19, pp. 294-304.*

M.J.Biologics "Autogenous killed PRRS viral antigen concentrate subunit vaccine," MJ Biologics Press Release (2006), XP002503279, URL:www.precisionnutriction.net/NP_Documents/PRRS_Presenter_03_06.pdf.

Wagner, M., et al. "Protection against heterologous PRRVS challenge in pregnant sows immunized with multivalent PRRSV vaccines," Intl. PRRS Symposium (2005), St Louis, MO, URL: www.mjbio.com/images/prrs_challeng.pdf.

Han, et al. "Complete genome analysis of RFPL 184 isolates of porcine reproductive and respiratory syndrome virus," Virus Research, Amsterdam, NL (2006) vol. 122, No. 1-2, pp. 175-182, XP005720349, ISSN: 0168-1702.

Plagemann, et al., "The Primary Neutralization Epitope of Porcine Respiratory and Reproductive Syndrome Virus Strain VR-2332 is located in the Middle of the GP5 Ectodomain," Archive of Virology, 147(2002), pp. 2327-2347.

Fang, et al., "Heterogeneity in Nsp2 of European-like Porcine Reproductive and Respiratory Syndrome Viruses Isolated in the United States," Virus Research 100 (2004) 229-235, www.elsevier.com/locate/viruses, www.sciencedirect.com.

Delputte et al., J. Virol., May 2002, 76(9):4312-4320.

Gonin et al., J. Vet. Diagn. Invest., 1999, 11:20-26.

Loemba et al., Arch. Virol., 1996, 141(3-4):751-761, abstract only.

Nelson et al., J. Vet. Diagn. Invest., 1994, 6:410-415.

Ostrowski et al., J. Virol., May 2002, 76(9):4241-4250.

Pirzadeh et al., J. Gen. Virol., 1998, 79:989-999.

Rodriguez et al., J. Gen. Virol., 2001, 82:995-999.

Yoon et al., J. Vet. Diagn. Invest., 1994, 6:289-292.

* cited by examiner

*Primary Examiner* — Anne M. Gussow

(74) *Attorney, Agent, or Firm* — Patentique PLLC

(57) ABSTRACT

The disclosure includes compositions and methods for the production of an immune response against porcine reproductive and respiratory syndrome (PRRS) virus, or PRRSV. The disclosure is based in part on the use of two or more peptide domains, each with a different sequence, from the PRRSV GP5 protein ectodomain. Compositions and methods comprising polypeptides containing the two or more domains, or nucleic acids encoding them, are described.

38 Claims, 76 Drawing Sheets

*Figure 1*

```
            |<---------Signal Sequence-------->|<-----HV1------>|< C. Area* >|<-HV2>|
                 1        10        20        30        40        50        61
VR-2332     -----MLEKCLTAGC  CSRLLSLWCI  VPFCFAVL AN  ASNDSSSHLQ  L IYNLTLCEL  NGT DWLANKFD
LV#         MRCSHKLGRFLTPHS  CFWWLFLLCT  GLSWS--F AD  GNGDSSTY-Q  Y IYNLTICEL  NGT DWLSSHFG
            1           15        25        33        42        52        63

                 70         80         90         100        110        120
VR-2332     WAVESFVIF  PVLTHIVSYG  ALTTSHFLDT  VALVTVSTAG  FVHGRYVLSS  IYAVCALAAL
LV          WAVETFVLY  PVATHILSLG  FLTTSHFFDA  LGLGAVSTAG  FVGGRYVLCS  VYGACAFAAF
                 72         82         92         102        112        122

                  130        140        150        160        170        180
VR-2332     TCFVIRFAKN  CMSWRYACTR  YTNFLLDTKG  RLYRWRSPVI  IEKRGKVEVE  GHLIDLKRVV
LV          VCFVIRAAKN  CMAYRYARTR  FTNFIVDDRG  RVHRWKSPIV  VEKLGKAEVD  GNLVTIKHVV
                  132        142        152        162        172        182

                  190        200
VR-2332     LDGSVATPIT  RVSAEQWGRP  (SEQ ID NO:13)
LV          LEGVKAQPLT  RTSAEQWEA   (SEQ ID NO:14)
                  192       201
```

* Conserved Area
\# Lelystad Virus

FIG. 3

| NCBI Accession No. | | Portion of GP5 N-terminal sequence including HV-1 Region, conserved motif and HV-2 Region | | |
|---|---|---|---|---|
| AAA47105 | 30 | SFADGNGDSSTYQYIYNLTICELNGTDWLSSHFG | 63 | (SEQ ID NO: 15) |
| AAA99068 | 21 | SFVDGNDNSSTYQYIYNLTICELNGTEWLSSHFD | 54 | (SEQ ID NO: 16) |
| AAC23802 | 28 | LANASNDSSSHVQLIYNLTLCELNGTDWLANKFD | 61 | (SEQ ID NO: 17) |
| AAC41212 | 28 | LVNASSTSSSHLQLIYNLTICELNGTDWLNEKFD | 61 | (SEQ ID NO: 18) |
| AAC41215 | 28 | LVNANTDSSSHLQLIYNLTICELNGTDWLNDKFD | 61 | (SEQ ID NO: 19) |
| AAC41224 | 28 | LVNASNNSSSHLQLIYNLTICELNGTDWLNDKFD | 61 | (SEQ ID NO: 20) |
| AAC54583 | 28 | LANASANSSSHLQLIYNLTLCELNGTDWLADKFD | 61 | (SEQ ID NO: 21) |
| AAC55357 | 21 | SFVDGNDSSSTYQYIYNLTICELNGTEWLSSHFD | 54 | (SEQ ID NO: 22) |
| AAC55358 | 21 | SFADGNGDSSTYQYIYNLTICELNGTAWLSSHFD | 54 | (SEQ ID NO: 23) |
| AAC55359 | 21 | SFADGNGDSSTYQYIYNLTICELNGTDWLSSHFD | 54 | (SEQ ID NO: 24) |
| AAC55360 | 21 | SFADGNGDSSTYQYIYNLTICELNGTEWLSSHFD | 54 | (SEQ ID NO: 25) |
| AAC55361 | 21 | SFVDGDNNSSTYQYIYNLTICELNGTNWLSSHFD | 54 | (SEQ ID NO: 26) |
| AAC55362 | 21 | SFADGNGSSSTYQYIYNLTICELNGTAWLSSYFD | 54 | (SEQ ID NO: 27) |
| AAC55363 | 21 | SFADGSGNSSTYQYIYNLTICELNGTDWLSSHFG | 54 | (SEQ ID NO: 28) |
| AAC55364 | 21 | SFADGNGDSSTYQYIYNLTICELNGTEWLSSHFG | 54 | (SEQ ID NO: 29) |
| AAC55365 | 21 | SFADGNGNSSTYQYIYNLTICELNGTDWLSGEFH | 54 | (SEQ ID NO: 30) |
| AAC55366 | 21 | SFADGNGNSSTYQYIYNLTICELNGTDWLSSHFG | 54 | (SEQ ID NO: 31) |
| AAC55367 | 21 | SFADGNGDSSTYQYIYNLTICELNGTDWLSSHFG | 54 | (SEQ ID NO: 32) |
| AAC55368 | 21 | SFADGNGDSSTYQYIYNLTICELNGTDWLSSHFG | 54 | (SEQ ID NO: 33) |
| AAC55369 | 21 | SFADGNGDSSTYQYIYNLTICELNGTDWLSSHFD | 54 | (SEQ ID NO: 34) |
| AAC55370 | 21 | SFADGNGDSSTYQYIYNLTICELNGTDWLSSHFD | 54 | (SEQ ID NO: 35) |
| AAC57952 | 28 | LVNANSASSSHLQLIYNLTLCELNGTDWLADKFD | 61 | (SEQ ID NO: 36) |
| AAC57953 | 28 | LGNANSTSSSHLQLIYNLTLCELNGTDWLANKFD | 61 | (SEQ ID NO: 37) |
| AAC57954 | 28 | LVNANSTSSSHLQLIYNLTLCELNGTDWLANKFD | 61 | (SEQ ID NO: 38) |
| AAC57955 | 28 | LVNANSNSSSHFQLIYNLTLCELNGTDWLANKFD | 61 | (SEQ ID NO: 39) |
| AAC57956 | 28 | LVNANSNSSSHFQLIYNLTLCELNGTDWLANKFD | 61 | (SEQ ID NO: 40) |
| AAC57957 | 28 | LVNANSSSSSHFQLIYNLTLCELNGTDWLAEKFD | 61 | (SEQ ID NO: 41) |
| AAC57959 | 28 | LVNANSSSSSHFQLIYNLTLCELNGTDWLAGKFD | 61 | (SEQ ID NO: 42) |
| AAC57963 | 28 | LANAHGNSSSHLQLIYNLTLCELNGTDWLADRFD | 61 | (SEQ ID NO: 43) |
| AAC57964 | 28 | LVNANSSSSSHFQLIYNLTLCELNGTDWLADKFD | 61 | (SEQ ID NO: 44) |
| AAC57971 | 28 | LVSANSNSSSHLQLIYNLTLCELNGTDWLANKFD | 61 | (SEQ ID NO: 45) |
| AAC57972 | 28 | LVSANSNSSSHLQLIYNLTLCELNGTDWLASRFD | 61 | (SEQ ID NO: 46) |
| AAD27656 | 28 | LANASNDSSSHLQLIYNLTLCELNGTDWLANKFD | 61 | (SEQ ID NO: 47) |
| AAD27663 | 28 | LVNASYSSSSHLQLIYNLTLCELNGTDWLANKFD | 61 | (SEQ ID NO: 48) |
| AAD27820 | 28 | LVNANSNSSSHLQLIYNLTLCELNGTDWLSNKFD | 61 | (SEQ ID NO: 49) |
| AAD37071 | 28 | LANASNDSSSHLQLIYNLTLCELNGTDWLANKFD | 61 | (SEQ ID NO: 50) |
| AAD37073 | 28 | LANASNDSSSHLQLIYNLTLCELNGTDWLANKFD | 61 | (SEQ ID NO: 51) |
| AAD37076 | 28 | LANASNNSSSHLQLIYNLTLCELNGKDWLANKFD | 61 | (SEQ ID NO: 52) |
| AAD37078 | 28 | LANASNDSSSHLQLIYNLTLCELNGTDWLANKFD | 61 | (SEQ ID NO: 53) |
| AAD37083 | 28 | LANASNDSSSHLQLIYNLTLCELNGTDWLANKFD | 61 | (SEQ ID NO: 54) |
| AAD37084 | 28 | LANASNNSSSHLQLIYNLTLCELNGTDWLANKFD | 61 | (SEQ ID NO: 55) |
| AAD37085 | 28 | LANASNDSSSHLQLIYNLTLCELNGTDWLANKFD | 61 | (SEQ ID NO: 56) |
| AAD37088 | 28 | LANASNDSSSHLQLIYNLTLCELNGTDWLANKFD | 61 | (SEQ ID NO: 57) |
| AAD37090 | 28 | LVNASNDSSSHLQLIYNLTLCELNGTDWLANKFD | 61 | (SEQ ID NO: 58) |
| AAF36230 | 28 | LVSANANSSSKLQLIYNLTLCELNGTDWLANKFD | 61 | (SEQ ID NO: 59) |
| AAF36231 | 28 | LANASANNSSHLQLIYNLTLCELNGTDWLANKFD | 61 | (SEQ ID NO: 60) |
| AAF36232 | 28 | LANASANSSSHLQLIYNLTLCELNGTDWLANKFD | 61 | (SEQ ID NO: 61) |
| AAF36235 | 28 | IVNASNNSSSHLQLIYNLTLCELNGTDWLADKFD | 61 | (SEQ ID NO: 62) |

FIG. 3 (con't)

| | | | | |
|---|---|---|---|---|
| AAF36236 | 28 | LVNANNNSSSHLQLIYNLTLCELNGTDWLANRFD | 61 | (SEQ ID NO: 63) |
| AAF36240 | 28 | LVNASNNSSSHLQLIYNLTLCELNGTDWLANKFD | 61 | (SEQ ID NO: 64) |
| AAF36242 | 28 | LVDASGNSSSHLQLIYNLTLCELNGTDWLANKFS | 61 | (SEQ ID NO: 65) |
| AAF36244 | 28 | LVNASNNSSSHFQLIYNLTLCELNGTDWLAGKFD | 61 | (SEQ ID NO: 66) |
| AAF36245 | 28 | IVNANSSSSSHFQLIYNLTLCELNGTDWLKNKFD | 61 | (SEQ ID NO: 67) |
| AAF36247 | 28 | LVNANSNSSSHLQLIYNLTLCELNGTDWLKDRFD | 61 | (SEQ ID NO: 68) |
| AAF36250 | 28 | IVNANSNSSSHFQLIYNLTLCELNGTDWLAEKFD | 61 | (SEQ ID NO: 69) |
| AAF36251 | 28 | IVNANSSSSSHFQLIYNLTLCELNGTDWLKNKFD | 61 | (SEQ ID NO: 70) |
| AAF36252 | 28 | LPNANENSSSHLQLIYNLTLCELNGTDWLADKFD | 61 | (SEQ ID NO: 71) |
| AAF36253 | 28 | LANASNDSSSHLQLIYNLTLCELNGTDWLANKFD | 61 | (SEQ ID NO: 72) |
| AAF36254 | 28 | LVSANSNSSSHLQLIYNLTLCELNGTDWLASKFD | 61 | (SEQ ID NO: 73) |
| AAF36256 | 28 | LANASNDSSSHLQLIYNLTLCELNGTDWLANKFD | 61 | (SEQ ID NO: 74) |
| AAF36257 | 28 | LANASNGSSSHLQLIYNLTLCELNGTDWLANKFD | 61 | (SEQ ID NO: 75) |
| AAF36260 | 28 | LANANNNSSSQLQLIYNLTLCELNGTDWLANKFD | 61 | (SEQ ID NO: 76) |
| AAF36265 | 28 | LVNANSNSSSHLQLIYNLTLCELNGTDWLSNKFD | 61 | (SEQ ID NO: 77) |
| AAF36268 | 28 | IVNANSNSSSHFQLIYNLTVCELNGTDWLTGKFD | 61 | (SEQ ID NO: 78) |
| AAF36269 | 28 | LANASNNSSSHLQLIYNLTLCELNGTDWLANKFD | 61 | (SEQ ID NO: 79) |
| AAF36273 | 28 | LANASNNSSSHLQLIYNLTLCELNGTDWLANKFD | 61 | (SEQ ID NO: 80) |
| AAF36275 | 28 | LVNADSNSSSHFQLIYNLTLCELNGTEWLANNFD | 61 | (SEQ ID NO: 81) |
| AAF36280 | 28 | LANASNNSSSHLQLIYNLTLCELNGTDWLANKFD | 61 | (SEQ ID NO: 82) |
| AAF36281 | 28 | LANANNASSSHLQLIYNLTLCELNGTDWLANKFD | 61 | (SEQ ID NO: 83) |
| AAF65938 | 28 | LVNASYSSSSHLQLIYNLTLCELNGTDWLANKFD | 61 | (SEQ ID NO: 84) |
| AAG13893 | 30 | SFADGNGNSSTYQYIYNLTICELNGTVWLSTNFY | 63 | (SEQ ID NO: 85) |
| AAG13894 | 30 | SFADGNGDSSTYQYIYNLTICELNGTDWLSSHFG | 63 | (SEQ ID NO: 86) |
| AAG13896 | 30 | SFADGNGDSSTYQYIYNLTICELNGTDWLSSHFG | 63 | (SEQ ID NO: 87) |
| AAG13897 | 30 | SFADGNGDSSTYQYIYNLTICELNGTDWLSSHFG | 63 | (SEQ ID NO: 88) |
| AAG13899 | 30 | SFADGNGNSSTYQYIYNLTICELNGTDWLSTKFY | 63 | (SEQ ID NO: 89) |
| AAG49624 | 28 | LANASNDSSSHLQLIYNLTLCELNGTDWLANKFD | 61 | (SEQ ID NO: 90) |
| AAK25804 | 28 | IVNASSNSSSHFQLIYNLTLCELNGTYWLANKFD | 61 | (SEQ ID NO: 91) |
| AAK25807 | 28 | LVNANSNSSSHFQLIYNLTLCELNGTDWLNEHFG | 61 | (SEQ ID NO: 92) |
| AAK25810 | 28 | LVNANSNSSSHFQLIYNLTLCELNGTDWLAEKFD | 61 | (SEQ ID NO: 93) |
| AAK44216 | 28 | LVNANSNSSSHFQLIYNLTLCELNGTDWLANKFD | 61 | (SEQ ID NO: 94) |
| AAK61620 | 30 | SFADGNGDSSTYQYIYNLTICELNGTDWLSSHFD | 63 | (SEQ ID NO: 95) |
| AAK61622 | 30 | SFADGNGNSSTYQYIYNLTICELNGTAWLSDKFY | 63 | (SEQ ID NO: 96) |
| AAK61623 | 30 | SFADGNGNSSTYQYIYNLTICELNGTAWLSSNFY | 63 | (SEQ ID NO: 97) |
| AAK61624 | 30 | SFADGNGNSSTYLYIYNLTICELNGTDWLSNKYY | 63 | (SEQ ID NO: 98) |
| AAK61625 | 30 | SFADGNGDSSTYQYIYNLTICELNGTAWLSSNFY | 63 | (SEQ ID NO: 99) |
| AAK61626 | 30 | SFADGNGDSSTYQYIYNLTICELNGTDWLSNNFY | 63 | (SEQ ID NO: 100) |
| AAK61627 | 30 | SFADGNGNSSTYQYIYNLTICELNGTNWLSNKFY | 63 | (SEQ ID NO: 101) |
| AAK61628 | 30 | SFADGNGNSSTYQYIYNLTICELNGTAWLSSNFY | 63 | (SEQ ID NO: 102) |
| AAK61629 | 31 | FADGSGNSSTYQYIYNLTICELNGTAWLSSHFD | 63 | (SEQ ID NO: 103) |
| AAK61630 | 30 | SFADGNGNSSTYQYIYNLTICELNGTDWLSDRFY | 63 | (SEQ ID NO: 104) |
| AAK61631 | 30 | SFADGNGNSSTYQYIYNLTICELNGTDWLSNRFY | 63 | (SEQ ID NO: 105) |
| AAK61632 | 30 | SFADGNGNSSTYQYIYNLTICELNGTDWLSNKFY | 63 | (SEQ ID NO: 106) |
| AAK61633 | 30 | SFADGNGNSSTYQYIYNLTICELNGTDWLSNNFY | 63 | (SEQ ID NO: 107) |
| AAK61634 | 30 | SFADGNGDSSTYQYIYNLTICELNGTDWLSDHFY | 63 | (SEQ ID NO: 108) |
| AAK61635 | 30 | SFADGNGNSSTYQYIYNLTICELNGTDWLSDHFY | 63 | (SEQ ID NO: 109) |
| AAK61636 | 30 | SFADGNGDSSTYQYIYNLTICELNGTAWLSSNFY | 63 | (SEQ ID NO: 110) |
| AAK61637 | 30 | SFADGSGNSSTYQYIYNLTICELNGTDWLSSHFS | 63 | (SEQ ID NO: 111) |
| AAK61638 | 30 | SFADGNGNSSTYQYIYNLTICELNGTDWLSSHFG | 63 | (SEQ ID NO: 112) |
| AAK61639 | 30 | SFADGNGNSSTYQYIYNLTICELNGTDWLSSHFG | 63 | (SEQ ID NO: 113) |
| AAK61640 | 30 | SFADGNGNSSTYQYIYNLTICELNGTNWLSSHFG | 63 | (SEQ ID NO: 114) |
| AAK61641 | 30 | SFADGNGNSLTYQYIYNLTICELNGTDWLSSHFG | 63 | (SEQ ID NO: 115) |
| AAK61642 | 30 | SFADGNGNSLTYQYIYNLTICELNGTDWLSSHFG | 63 | (SEQ ID NO: 116) |
| AAK61643 | 30 | SFADGNGDSSTYQYIYNLTICELNGTDWLSSHFG | 63 | (SEQ ID NO: 117) |

FIG. 3 (con't)

| | | | | |
|---|---|---|---|---|
| AAK61644 | 30 | SFADGNGDSSTYQYIYNLTICELNGTDWLSSHFG | 63 | (SEQ ID NO: 118) |
| AAK61645 | 30 | SFADGSGDSSTYQYIYNLTICELNGTAWLSSHFD | 63 | (SEQ ID NO: 119) |
| AAK61646 | 30 | SFADGNGNSSTYQYIYNLTICELNGTYWLSSHFS | 63 | (SEQ ID NO: 120) |
| AAK61648 | 30 | SFADGNGNSSTYQYIYNLTICELNGTDWLSDKFD | 63 | (SEQ ID NO: 121) |
| AAK61649 | 30 | SFADGNGNSSTYQYIYNLTICELNGTAWLSDHFQ | 63 | (SEQ ID NO: 122) |
| AAK61650 | 30 | SFAEGNGNSSTYQYIYNLTICELNGTDWLSAHFE | 63 | (SEQ ID NO: 123) |
| AAK61651 | 30 | SFADGNGNSSTYQYIYNLTICELNGTHWLSNHFD | 63 | (SEQ ID NO: 124) |
| AAK61652 | 30 | SFAECNGNSSTYRSIYNLTICELNGTQWLSDKFD | 63 | (SEQ ID NO: 125) |
| AAK61654 | 30 | SFADGNGNSSTYQYIYNLTICELNGTEWLSNKFY | 63 | (SEQ ID NO: 126) |
| AAK61655 | 30 | SFADGGGNSSTYQYIYNLTICELNGTAWLSNHFH | 63 | (SEQ ID NO: 127) |
| AAK61656 | 30 | SFVAGSGNSSTYQYIYNLTICELNGTDWLSNHFD | 63 | (SEQ ID NO: 128) |
| AAK61657 | 30 | SFADGSGNSSTYQYIYNLTICELNGTAWLSSHFD | 63 | (SEQ ID NO: 129) |
| AAK61658 | 30 | SFADGNGSSSTYQYIYNLTICELNGTDWLSSHFG | 63 | (SEQ ID NO: 130) |
| AAK61659 | 30 | SFADGNGNSSTYQYIYNLTICELNGTDWLSSHFG | 63 | (SEQ ID NO: 131) |
| AAK61660 | 30 | SFADGNGNSSTYQYIYNLTICELNGTDWLSSHFG | 63 | (SEQ ID NO: 132) |
| AAK61661 | 30 | SFADGNGNSSTYQYIYNLTICELNGTAWLSDHFD | 63 | (SEQ ID NO: 133) |
| AAK61664 | 30 | SFADGNGNSSTYQYIYDLTICELNGTQWLSDNFY | 63 | (SEQ ID NO: 134) |
| AAK61667 | 30 | SFADGNGNSSTYQYIYNLTICELNGTTWLHDRFD | 63 | (SEQ ID NO: 135) |
| AAK61670 | 30 | SFADGNGDSSTYQYIYNLTICELNGTDWLSNNFY | 63 | (SEQ ID NO: 136) |
| AAL26234 | 30 | SFADGNGDSSTYQYIYNLTICELNGTDWLSSHFG | 63 | (SEQ ID NO: 137) |
| AAL26237 | 30 | SFADGNGDSSTYQYIYNLTICELNGTDWLSSHFG | 63 | (SEQ ID NO: 138) |
| AAL26241 | 30 | SFADGNGDSSTYQYIYNLTICELNGTDWLSSHFG | 63 | (SEQ ID NO: 139) |
| AAM15937 | 30 | SFADGNGNSSTYQYIYNLTICELNGTAWLANHFE | 63 | (SEQ ID NO: 140) |
| AAM15938 | 32 | FADGNGNSSTYQYIYLTICELNGTGWLANHFE | 64 | (SEQ ID NO: 141) |
| AAM15940 | 30 | SFADCNDNSSTYQYIYNLTICELNGTKWLSSHFD | 63 | (SEQ ID NO: 142) |
| AAM15941 | 30 | SFVDGNDSSSTYQYIYNLTICELNGTEWLPSHFD | 63 | (SEQ ID NO: 143) |
| AAM15943 | 30 | SFADGNGNSSTYQYIYKLTICELNGTEWLSTHFD | 63 | (SEQ ID NO: 144) |
| AAM15945 | 30 | SFADGNGNSSTHQYIYNLTICELNGTNWLSNHFG | 63 | (SEQ ID NO: 145) |
| AAM15946 | 30 | SFVAGNDNSSTYQYIYNLTICELNGTEWLSGHFA | 63 | (SEQ ID NO: 146) |
| AAM15947 | 30 | SFVDGNGNSSTYQYIYNLTICELNGTKWLSSHFY | 63 | (SEQ ID NO: 147) |
| AAM15948 | 30 | SFVDGNVSSSTYQYIYDLTICELNGTEWLHSHFD | 63 | (SEQ ID NO: 148) |
| AAM15950 | 30 | SFVAGSDNSSTYQYIYNLTICELNGTDWLSNHFD | 63 | (SEQ ID NO: 149) |
| AAM15951 | 30 | SFVAGNDNSSTYQYIYNLTICELNGTEWLSGHFA | 63 | (SEQ ID NO: 150) |
| AAM15952 | 30 | SFADGNDNSSTYQYIYDLTICELNGTYWLSNHFS | 63 | (SEQ ID NO: 151) |
| AAM15954 | 30 | SSVDGNGNSSTYQYIYNLTICELNGTDWLSASFS | 63 | (SEQ ID NO: 152) |
| AAM15957 | 30 | SFVAVSGNSSTYQYIYNLTICELNGTNWLSDHFD | 63 | (SEQ ID NO: 153) |
| AAM15958 | 30 | SFVAVSGNSSTYQYIYNLTICELNGTNWLPDHFD | 63 | (SEQ ID NO: 154) |
| AAM15959 | 30 | SFADGNGNSSTYQYIYNLTICELNGTAWLSDHFD | 63 | (SEQ ID NO: 155) |
| AAM53942 | 30 | SSADGNGNSSTYQYIYNLTICELNGTGWLTAHFE | 63 | (SEQ ID NO: 156) |
| AAN04104 | 28 | LANASNDSSSHLQLIYNLTLCELNGTDWLANKFD | 61 | (SEQ ID NO: 157) |
| AAN09724 | 1 | DGNGNSSTYQYIYNLTICELNGTDWLSSHFG | 31 | (SEQ ID NO: 158) |
| AAN09725 | 1 | DGNGNSSTYQYIYNLTICELNGTKWLSSHFD | 31 | (SEQ ID NO: 159) |
| AAN09727 | 2 | ASGNSSTYQYIYNLTICELNGTEWLSGHFD | 31 | (SEQ ID NO: 160) |
| AAN09728 | 2 | ASGNSSTLQYIYNLTICELNGTDWLANKFD | 31 | (SEQ ID NO: 161) |
| AAN09731 | 1 | DGNDNSSTYQYIYNLTICELNGTKWLSSHFD | 31 | (SEQ ID NO: 162) |
| AAN09732 | 1 | DGNGNSSTYQYIYNLTICELNGTEWLSSHFS | 31 | (SEQ ID NO: 163) |
| AAN09733 | 1 | DGNGNSSTYQYIYNLTICELNGTEWLSSHFD | 31 | (SEQ ID NO: 164) |
| AAN09736 | 1 | DGNGNSSTYQYIYNLTICELNGTKWLSGHFD | 31 | (SEQ ID NO: 165) |
| AAN09737 | 1 | DGSGNSSTYLYIYNLTICELNGTQWLSDHFS | 31 | (SEQ ID NO: 166) |
| AAN09740 | 1 | DGNDNSSTYQYIYNLTICELNGTEWLSSHFD | 31 | (SEQ ID NO: 167) |
| AAN09742 | 2 | GSGNSSTYQYIYNLTICELNGTDWLSNHFD | 31 | (SEQ ID NO: 168) |
| AAN09743 | 1 | DGNGNSSTYQYIYNLTICELNGTDWLSNHFS | 31 | (SEQ ID NO: 169) |
| AAN09745 | 1 | DGSDNSSTYQYIYNLMICELNGTQWLSNHFS | 31 | (SEQ ID NO: 170) |
| AAN09746 | 1 | DGNGNSSTYQYIYNLTICELNGTDWLSSHFG | 31 | (SEQ ID NO: 171) |
| AAO33781 | 21 | LANASDNSSSHLQLIYNLTLCELNGTDWLANKFD | 54 | (SEQ ID NO: 172) |

FIG. 3 (con't)

| | | | | |
|---|---|---|---|---|
| AAO33782 | 21 | LANASNNSSSHLQLIYNLTLCELNGTDWLANKFD | 54 | (SEQ ID NO: 173) |
| AAO33784 | 21 | LANASNDSSSHLQLIYNLTLCELNGTDWLANKFD | 54 | (SEQ ID NO: 174) |
| AAO33785 | 21 | LANASNDSSSHLQLIYNLTLCELNGTDWLANKFD | 54 | (SEQ ID NO: 175) |
| AAO33786 | 21 | LANADSNSSSHLQLIYNLTLCELNGTDWLANKFD | 54 | (SEQ ID NO: 176) |
| AAO33787 | 21 | LANADSNSSSHLQLIYNLTLCELNGTDWLANKFD | 54 | (SEQ ID NO: 177) |
| AAO33789 | 21 | LANASNNSSSHLQLIYNLTLCELNGTDWLASKFD | 54 | (SEQ ID NO: 178) |
| AAO33790 | 21 | LANADSNSSSHLQLIYNLTLCELNGTDWLANKFD | 54 | (SEQ ID NO: 179) |
| AAO33791 | 21 | LVNANSNSSSHLQLIYNLTLCELNGTDWLSNKFD | 54 | (SEQ ID NO: 180) |
| AAO33792 | 21 | LVNASNGSSSHLQLIYNLTLCELNGTDWLANRFD | 54 | (SEQ ID NO: 181) |
| AAO33793 | 21 | LANASANSSSHIQLIYNLTLCELNGTDWLANKFD | 54 | (SEQ ID NO: 182) |
| AAO33794 | 21 | LVNANGNSSSHLQLIYNLTLCELNGTDWLANKFD | 54 | (SEQ ID NO: 183) |
| AAO33801 | 21 | LVSADRNSSSNLQLIYNLTLCELNGTDWLANKFD | 54 | (SEQ ID NO: 184) |
| AAO33804 | 21 | LVSANSNSSSHLQLIYNLTLCELNGTDWLASRFD | 54 | (SEQ ID NO: 185) |
| AAO33805 | 21 | LVSANSNSSSHLQLIYNLTLCELNGTDWLASRFD | 54 | (SEQ ID NO: 186) |
| AAO33806 | 21 | LVNANGNSSSHLQLIYNLTLCELNGTDWLADKFD | 54 | (SEQ ID NO: 187) |
| AAO33809 | 21 | LVNANSNSSSHLQLIYNLTLCELNGTDWLKDKFD | 54 | (SEQ ID NO: 188) |
| AAO33810 | 21 | LVNANSNSSSHLQLIYNLTLCELNGTDWLKDKFD | 54 | (SEQ ID NO: 189) |
| AAO43504 | 30 | SFADGNGNSSTYQYIYDLTICELNGTAWLSGNFH | 63 | (SEQ ID NO: 190) |
| AAO43505 | 30 | SFAECNGNSSTHQYIYNLTVCELNGTAWLSSHFD | 63 | (SEQ ID NO: 191) |
| AAO43506 | 30 | SFADGNGNSSTYQYIYNLTICELNGTDWLSNRFY | 63 | (SEQ ID NO: 192) |
| AAO43507 | 30 | SFADGNGNSSTYQYIYNLTICELNGTEWLSDKFY | 63 | (SEQ ID NO: 193) |
| AAO43508 | 30 | SFADGNGNSSTYQYIYNLTICELNGTDWLSNRFY | 63 | (SEQ ID NO: 194) |
| AAO43509 | 30 | SFADGNGNSSTYQYIYDLTICELNGTDWLSGHFD | 63 | (SEQ ID NO: 195) |
| AAO43510 | 30 | SFADGNGNNSTYQYIYNLTICELNGTSWLHGHFD | 63 | (SEQ ID NO: 196) |
| AAO43511 | 31 | FADGNGNSSTYQYIYNLTICELNGTEWLSNKFD | 63 | (SEQ ID NO: 197) |
| AAO43512 | 30 | SFAECNGNSSTHQYIYNLTICELNGTNWLSNHFD | 63 | (SEQ ID NO: 198) |
| AAO43513 | 30 | SFAECNGDSSTSQYIYNLTICELNGTAWLSEHFD | 63 | (SEQ ID NO: 199) |
| AAO43514 | 30 | SFADGNGNSSTYQYIYNLTICELNGTDWLSDRFD | 63 | (SEQ ID NO: 200) |
| AAO43516 | 30 | SFADGNGNSSTYQYIYNLTICELNGTTWLSKEFD | 63 | (SEQ ID NO: 201) |
| AAO43517 | 30 | SFADGNGNSSTYQYIYNLTICELNGTEWLSNKFY | 63 | (SEQ ID NO: 202) |
| AAO43518 | 30 | SFADGNGNSSTYQYIYNLTICELNGTEWLSNKFY | 63 | (SEQ ID NO: 203) |
| AAO43519 | 30 | SFAECTGNSSTYQYIYNLTICELNGTNWLTGHFG | 63 | (SEQ ID NO: 204) |
| AAO43520 | 30 | SFADGNGNSSTYQYIYNLTICELNGTAWLSEHFQ | 63 | (SEQ ID NO: 205) |
| AAO43525 | 30 | SFADGNGNSSTYQYIYNLTICELNGTDWLSDRFD | 63 | (SEQ ID NO: 206) |
| AAO43526 | 30 | SFAECNGNSSTYQYIYNLTICELNGTDWLSDKFY | 63 | (SEQ ID NO: 207) |
| AAO43527 | 30 | SFADGSGNSSTYQYIYDLTICELNGTNWLSGHFD | 63 | (SEQ ID NO: 208) |
| AAO43528 | 30 | SFADGNGNSSTYQYIYNLTICELNGTNWLSDKFY | 63 | (SEQ ID NO: 209) |
| AAO43529 | 30 | SFADGNGNSSAYQYIYNLTICELNGTDWLSDKFY | 63 | (SEQ ID NO: 210) |
| AAO43530 | 30 | SFADGNGNSSTYQYIYNLTICELNGTDWLSDKFY | 63 | (SEQ ID NO: 211) |
| AAO43531 | 30 | SFADGNDNSSTYQYIYNLTICELNGTHWLHQHFS | 63 | (SEQ ID NO: 212) |
| AAO43532 | 30 | SFADGNGNSSTYQYIYNLTICELNGTAWLSDHFY | 63 | (SEQ ID NO: 213) |
| AAO43533 | 30 | SFADGNGNSSTYQYIYNLTICELNGTTWLSNHFY | 63 | (SEQ ID NO: 214) |
| AAO43534 | 30 | SFADGSGNSSTYQYIYNLTICELNGTTWLSNHFD | 63 | (SEQ ID NO: 215) |
| AAO43535 | 30 | SFADGNGNSSTYQYIYNLTICELNGTAWLHDHFY | 63 | (SEQ ID NO: 216) |
| AAO43536 | 30 | SFADGNGNSSTYQYIYNLTICELNGTAWLSDHFD | 63 | (SEQ ID NO: 217) |
| AAP57179 | 26 | SFAGGNGNSSTYQYIYNLTICELNGTAWLSDHFY | 59 | (SEQ ID NO: 218) |
| AAP57181 | 26 | SFADGNGNSSTYQYIYNLTICELNGTEWLSSHFH | 59 | (SEQ ID NO: 219) |
| AAP57182 | 30 | SFADGNGNSSTYQYIYNLTICELNGTDWLSSHFG | 63 | (SEQ ID NO: 220) |
| AAP57183 | 30 | SFADGNGDSSTYQYIYNLTICELNGTDWLSSHFG | 63 | (SEQ ID NO: 221) |
| AAP57184 | 26 | SFADGNGNSSTYQYIYNLTICELNGTAWLSDHFY | 59 | (SEQ ID NO: 222) |
| AAP75749 | 28 | LVNANSNSSSHLQLIYNLTLCELNGTDWLANRFD | 61 | (SEQ ID NO: 223) |
| AAP75750 | 28 | LVNANSNSSSHLQLIYNLTLCELNGTDWLANRFD | 61 | (SEQ ID NO: 224) |
| AAP75753 | 28 | LVNANSNSSSHLQLIYNLTLCELNGTDWLANRFD | 61 | (SEQ ID NO: 225) |
| AAP75755 | 28 | LVNANSNSSSHLQLIYNLTLCELNGTDWLADRFD | 61 | (SEQ ID NO: 226) |
| AAP75756 | 28 | LVNANSNSSSHFQSIYNLTLCELNGTDWLADKFD | 61 | (SEQ ID NO: 227) |

FIG. 3 (con't)

| | | | | |
|---|---|---|---|---|
| AAP75757 | 28 | LVNANSNNSSHFQSIYNLTLCELNGTDWLANKFD | 61 | (SEQ ID NO: 228) |
| AAQ02956 | 28 | LVNASSNSSSHFQLIYNLTLCELNGTDWLANKFD | 61 | (SEQ ID NO: 229) |
| AAQ02962 | 28 | LVNASSTSSSHFQLIYNLTLCELNGTDWLANKFD | 61 | (SEQ ID NO: 230) |
| AAQ02968 | 28 | LVNASSTSSSHFQLIYNLTLCELNGTDWLANKFD | 61 | (SEQ ID NO: 231) |
| AAQ02974 | 28 | LVNANSNSSSHLQLIYNLTLCELNGTDWLKDKFD | 61 | (SEQ ID NO: 232) |
| AAQ02980 | 28 | LVNANSNSSSHLQLIYNLTLCELNGTDWLKDKFD | 61 | (SEQ ID NO: 233) |
| AAQ02986 | 28 | LVNANSNSSSHLQLIYNLTLCELNGTDWLKDKFD | 61 | (SEQ ID NO: 234) |
| AAR11531 | 30 | SFADGNGNNSTYQYIYNLTICELNGTNWLSGHFD | 63 | (SEQ ID NO: 235) |
| AAR19405 | 28 | LANANNDSSSHLQLIYNLTLCELNGTDWLANKFD | 61 | (SEQ ID NO: 236) |
| AAR32999 | 30 | SFADGSGNSSTYQYIYNLTICELNGTDWLSNHFS | 63 | (SEQ ID NO: 237) |
| AAR33006 | 30 | SFADGNGNNSTYQYIYNLTICELNGTNWLSGHFE | 63 | (SEQ ID NO: 238) |
| AAR33013 | 30 | SFVDGNGINSTYQYIYNLTICELNGTNWLSDHFE | 63 | (SEQ ID NO: 239) |
| AAR84053 | 30 | SFVDGNGINSTYQYIYDLTICELNGTNWLSDHFE | 63 | (SEQ ID NO: 240) |
| AAR84054 | 30 | SFADGNGNNSIYQYIYNLTVCELNGTNWLSDHFE | 63 | (SEQ ID NO: 241) |
| AAR84057 | 31 | FADGNGINSTYQYIYNLTICELNGTNWLSNHFE | 63 | (SEQ ID NO: 242) |
| AAR84058 | 30 | SFADGNGNNSTYQYIYNLTICELNGTDWLSGHFD | 63 | (SEQ ID NO: 243) |
| AAR84059 | 31 | FADGNNINSTYQYIYNLTICELNGTNWLSDHFE | 63 | (SEQ ID NO: 244) |
| AAR84060 | 30 | SFADGNGNNSTYQYIYNLTICELNGTNWLSAHFE | 63 | (SEQ ID NO: 245) |
| AAR84061 | 31 | FADGNGINSTYQYIYNLTICELNGTNWLSDHFE | 63 | (SEQ ID NO: 246) |
| AAR84062 | 30 | SFADGNGNNSTYQYIYNLTICELNGTNWLSAHFE | 63 | (SEQ ID NO: 247) |
| AAR84063 | 30 | SFADGNGNNSTYQYIYNLTICELNGTYWLSAHFE | 63 | (SEQ ID NO: 248) |
| AAR84064 | 30 | SSADGNGNSSTYQYIYNLTICELNGTGWLSAHFE | 63 | (SEQ ID NO: 249) |
| AAR91613 | 30 | SFADGNGNNSTYQYIYNLTICELNGTNWLSDHFE | 63 | (SEQ ID NO: 250) |
| AAR91614 | 30 | SFADGNGNNSTYQYIYNLTICELNGTAWLSGHFD | 63 | (SEQ ID NO: 251) |
| AAR91617 | 30 | SSADGNGNSSTYQYIYNSTICELNGTGWLSDHFE | 63 | (SEQ ID NO: 252) |
| AAR97916 | 28 | LANASDDSSSHLQLIYNLTLCELNGTDWLANKFD | 61 | (SEQ ID NO: 253) |
| AAS78205 | 28 | LVNANGNSSSNLQLIYNLTLCELNGTDWLANKFD | 61 | (SEQ ID NO: 254) |
| AAS78217 | 28 | IVNATSNSSSHFQLIYNLTLCELNGTDWLVNKFD | 61 | (SEQ ID NO: 255) |
| AAT38932 | 28 | LANASSDSSSHLQLIYNLTLCELNGTDWLANKFD | 61 | (SEQ ID NO: 256) |
| AAT70759 | 30 | SFADGNGNSSTYQYIYNLTICELNGTDWLSSHFG | 63 | (SEQ ID NO: 257) |
| AAT70761 | 30 | SFADGNGNSSTYQYIYNLTICELNGTRWLSSHFD | 63 | (SEQ ID NO: 258) |
| AAT70762 | 30 | SFADGNGNSSTYQYIYDLTICELNGTRWLSSHFD | 63 | (SEQ ID NO: 259) |
| AAT70763 | 30 | SFVDGNDNSSTYQYIYNLTICELNGTAWLSSHFD | 63 | (SEQ ID NO: 260) |
| AAT70764 | 30 | SSVDGNGSSSTRQYIYNLTICELNGTEWLSGHFD | 63 | (SEQ ID NO: 261) |
| AAT70765 | 30 | SFADGNGNSSTYQYIYNLTICELNGTDWLTNHFD | 63 | (SEQ ID NO: 262) |
| AAT70766 | 30 | SFADGNGNSSTYQYIYNLTICELNGTDWLTNHFD | 63 | (SEQ ID NO: 263) |
| AAT77158 | 30 | SFADGNGDSSTYQYIYNLTICELNGTDWLSSHFG | 63 | (SEQ ID NO: 264) |
| AAU84717 | 28 | LANASNDSSSHLQLIYNLTLCELNGTDWLANKFD | 61 | (SEQ ID NO: 265) |
| AAU95483 | 28 | LANASNDSSSHLQLIYNLTLCELNGTDWLANKFD | 61 | (SEQ ID NO: 266) |
| AAV71018 | 28 | LVNANSNSSSHLQLIYNLTICELNGTDWLNNHFS | 61 | (SEQ ID NO: 267) |
| AAV91512 | 21 | SFADGNGNSSTYQYIYNLTICELNGTQWLSDQFS | 54 | (SEQ ID NO: 268) |
| AAW58004 | 30 | SFADGNGNSSTYQYIYNLTICELNGTGWLSNHFD | 63 | (SEQ ID NO: 269) |
| AAW78901 | 30 | SFADGNGNSSTYQYIYNLTICELNGTDWLSSHFG | 63 | (SEQ ID NO: 270) |
| AAW78902 | 30 | SFADGNGNGSTYQYIYNLTICELNGTNWLSDHFD | 63 | (SEQ ID NO: 271) |
| AAW78903 | 30 | SFADGNGNSSTYQYIYNLTICELNGTDWLSKHFD | 63 | (SEQ ID NO: 272) |
| AAW78905 | 30 | SFADGNGNSSTYQYIYNLTICELNGTDWLSKHFD | 63 | (SEQ ID NO: 273) |
| AAW78906 | 30 | SFADGNGNSSTYQYIYNLTICELNGTDWLSSHFD | 63 | (SEQ ID NO: 274) |
| AAW80584 | 30 | SFADGNGNSSTYQYIYNLTICELNGTDWLSNHFD | 63 | (SEQ ID NO: 275) |
| AAW81297 | 30 | SFADGNGNNSTYQYIYNLTICELNGTAWLFGHFD | 63 | (SEQ ID NO: 276) |
| AAW81301 | 30 | SFADGNGNNSTYQYIYNLTICELNGTEWLSGHFD | 63 | (SEQ ID NO: 277) |
| AAW81309 | 30 | SFADGNGNNSTYQYIYNLTICELNGTEWLSDHFD | 63 | (SEQ ID NO: 278) |
| AAW81313 | 30 | SFVDGNDTNSTYQYIYNLTICELNGTNWLSDHFE | 63 | (SEQ ID NO: 279) |
| AAW81331 | 30 | SFADGNGNNSTYQYIYNLTICELNGTNWLSGHFE | 63 | (SEQ ID NO: 280) |
| AAW82324 | 28 | LVNANSSSSSHFQLIYNLTLCELNGTEWLANKFD | 61 | (SEQ ID NO: 281) |
| AAX16020 | 30 | SFADGNGTSSTYQYIYNLTICELKGTDWLSKHFD | 63 | (SEQ ID NO: 282) |

FIG. 3 (con't)

| | | | | |
|---|---|---|---|---|
| AAX16021 | 30 | SFADGNGNSSTYQYIYNLTICELNGTDWLSKHFD | 63 | (SEQ ID NO: 283) |
| AAX16022 | 30 | SFADGSDNSSTYQYIYNMTICELNGTQWLSGQFD | 63 | (SEQ ID NO: 284) |
| AAX16023 | 30 | SFADGSDNSSTYQYIYNMTICELNGTQWLSGQFD | 63 | (SEQ ID NO: 285) |
| AAX16024 | 30 | SFADGNGNSSTYQYIYNLTICELNGISWLPNHFN | 63 | (SEQ ID NO: 286) |
| AAX16026 | 30 | SFADGNGNSSTYQYIYNLTICELNGTAWLSGHFD | 63 | (SEQ ID NO: 287) |
| AAX16027 | 30 | SFADGNGNSSTYLYIYNLTICELNGTAWLSEHFD | 63 | (SEQ ID NO: 288) |
| AAX16028 | 30 | SFADGNGNSSTYQYIYNLTICELNGTTWLQHHFD | 63 | (SEQ ID NO: 289) |
| AAX16029 | 30 | SFADGNGNSSTYQYIYNLTICELNGTDWLSKHFD | 63 | (SEQ ID NO: 290) |
| AAX16031 | 30 | SFADGNGNSSTYQYIYNLTICELNETAWLSGHFD | 63 | (SEQ ID NO: 291) |
| AAX16032 | 30 | SFADGNGNSSTYQYIYNLTICELNGTSWLSNHFD | 63 | (SEQ ID NO: 292) |
| AAX16033 | 30 | SFAVGSGNSSTYQYIYNLTICELNGTAWLHGHFA | 63 | (SEQ ID NO: 293) |
| AAX16035 | 30 | SFADGNDNSSTYQYIYNMTICELNGTDWLSGHFD | 63 | (SEQ ID NO: 294) |
| AAX16038 | 30 | SSADGNGNSSTYQYIYNLTICELNGTTWLSEHFH | 63 | (SEQ ID NO: 295) |
| AAX16039 | 30 | SFADGNGSSSTYQYIYNLTICELNGTSWLSDHFD | 63 | (SEQ ID NO: 296) |
| AAX16040 | 30 | SFADGNGNSSTYQYIYNLTICELNGTAWLSSHFS | 63 | (SEQ ID NO: 297) |
| AAX16041 | 30 | SFADGNGNSSTYQYIYNLTICELNGTDWLSDHFD | 63 | (SEQ ID NO: 298) |
| AAX16042 | 30 | SFADGNGNSSTYLYIYNLTICELNETAWLSEHFD | 63 | (SEQ ID NO: 299) |
| AAX16044 | 30 | SFADGNGDSSIYLYIYNLTICELNETAWLSEHFD | 63 | (SEQ ID NO: 300) |
| AAX16045 | 30 | SFADGNGNSSTYLYIYNLTICELNETAWLSEHFD | 63 | (SEQ ID NO: 301) |
| AAX16046 | 30 | SFADGNGDSSIYLYIYNLTICELNETAWLSEHFD | 63 | (SEQ ID NO: 302) |
| AAX16047 | 30 | SFADGNGNSSTYQYIYNLTICELNGTAWLSGHFD | 63 | (SEQ ID NO: 303) |
| AAX16048 | 30 | SFADGNGNSSTYQYIYDLTICELNGTGWLSNHFD | 63 | (SEQ ID NO: 304) |
| AAX16049 | 30 | SFADGNGNSLTYQYIYDLTICELNGTGWLSNHFD | 63 | (SEQ ID NO: 305) |
| AAX16050 | 30 | SFADGNGNSSTYQYIYNLTICELNGTGWLSNHFD | 63 | (SEQ ID NO: 306) |
| AAX16051 | 30 | SFADGNGNSSTYQYIYDLTICELNGTGWLFGHFD | 63 | (SEQ ID NO: 307) |
| AAX16052 | 30 | SFADGNGNSSTYQYIYNLTICELNGTAWLSNHFN | 63 | (SEQ ID NO: 308) |
| AAX16053 | 30 | SFADGNGNSSTYQYIYNLTICELNGTGWLFGHFD | 63 | (SEQ ID NO: 309) |
| AAX16054 | 30 | SFADGNGNGSTYQYIYNLTICELNGTDWLSSHFN | 63 | (SEQ ID NO: 310) |
| AAX16055 | 30 | SFADGNGDSSTYQYIYDLTICELNGTGWLSNHFD | 63 | (SEQ ID NO: 311) |
| AAX16057 | 30 | SFADGNGNSSTYQYIYNLTICELNGTDWLSKHFD | 63 | (SEQ ID NO: 312) |
| AAX16059 | 30 | SFADGNGNSSTYQYIYDLTICELNGTAWLQNHFS | 63 | (SEQ ID NO: 313) |
| AAX16060 | 30 | SFADGNGNSSTYQYIYNLTICELNGTDWLSGGFD | 63 | (SEQ ID NO: 314) |
| AAX16061 | 30 | SFADGNDNSSTYQYIYNLTICELNGTGWLSNHFD | 63 | (SEQ ID NO: 315) |
| AAX16062 | 30 | SFAECNGDSSTYQYIYDLTICELNETAWLSGHFD | 63 | (SEQ ID NO: 316) |
| AAX16063 | 30 | SFAECNGNSSTYQYIYDLTICELNETAWLSGHFD | 63 | (SEQ ID NO: 317) |
| AAX16064 | 30 | SFAECNGNSSTYQYIYDLTICELNETAWLSGHFD | 63 | (SEQ ID NO: 318) |
| AAX16071 | 31 | FAECNGNGSTYQYIYNLTICELNGTNWLSNNFD | 63 | (SEQ ID NO: 319) |
| AAX16073 | 30 | SFADGNGNSSTYQYIYNLTICELNGTGWLSNHFD | 63 | (SEQ ID NO: 320) |
| AAX16074 | 30 | SFADGNGNSSTYQYIYNLTICELNGTAWLSGHFD | 63 | (SEQ ID NO: 321) |
| AAX63217 | 30 | SFADGNGNSSTYQYIYNLTICELNGTDWLVSHFD | 63 | (SEQ ID NO: 322) |
| AAX63219 | 30 | SFADGNGNSSTYQYIYNLTICELNGTEWLSTHFV | 63 | (SEQ ID NO: 323) |
| AAX63220 | 30 | SFADGNGNSSTYQYIYNLTICELNGTDWLSSHFG | 63 | (SEQ ID NO: 324) |
| AAX63221 | 30 | SFADGNGNSSTYQYIYNLTICELNGTDWLTNHFD | 63 | (SEQ ID NO: 325) |
| AAX63222 | 30 | SFADGNGNSSTFQYIYNLTICELNGTDWLAGHFD | 63 | (SEQ ID NO: 326) |
| AAX63223 | 30 | SSADGNGSSSTYQYIYNLTICELNGTDWLASHFD | 63 | (SEQ ID NO: 327) |
| AAX63224 | 30 | SFADGNGNSSTYQYIYNLTICELNGTHWLTSHFD | 63 | (SEQ ID NO: 328) |
| AAX63225 | 30 | SFADGNGNSSTYQYIYNLTICELNGTDWLASHFD | 63 | (SEQ ID NO: 329) |
| AAX63226 | 31 | FADGNGNSSTYQSIYNLTICELNGTGWLTSHFD | 63 | (SEQ ID NO: 330) |
| AAY33747 | 30 | SFADGNGNSSTYQYIYDLTICELNGTGWLSNHFS | 63 | (SEQ ID NO: 331) |
| AAY33748 | 30 | SFVDGNDNSSTYQYIYNLTICELNGTAWLSNHFY | 63 | (SEQ ID NO: 332) |
| AAY33750 | 30 | SFADGNGNSSTYQYIYDLTICELNGTGWLSNHFS | 63 | (SEQ ID NO: 333) |
| AAY33752 | 30 | SFADGNGNSSTYQYIYDLTICELNGTGWLSNHFS | 63 | (SEQ ID NO: 334) |
| AAY33756 | 30 | SFAVGSGNSSTRQYIYNLTICELNGTTWLSSHFD | 63 | (SEQ ID NO: 335) |
| AAY33758 | 30 | SFADGNGNSSTYQYIYNLTICELNGTEWLSSHFD | 63 | (SEQ ID NO: 336) |
| AAY33759 | 30 | SFADGNGNSSTYQYIYNLTICELNGTEWLSSHFD | 63 | (SEQ ID NO: 337) |

FIG. 3 (con't)

| | | | | |
|---|---|---|---|---|
| AAY33760 | 30 | SFADGNGNSSTYQYIYNLTICELNGTDWLSSHFG | 63 | (SEQ ID NO: 338) |
| AAY33762 | 31 | FVYGNDNSSTYQYIYNLTICELNGTSWLSTHFS | 63 | (SEQ ID NO: 339) |
| AAY33763 | 30 | SFADGNGNSSTYQYIYNLTICELNGTAWLFNHFD | 63 | (SEQ ID NO: 340) |
| AAY33764 | 30 | SFADGNGNSSTYQYIYNLTICELNGTGWLSNHFE | 63 | (SEQ ID NO: 341) |
| AAY33765 | 30 | SFVDGNDSSSTYQYIYNLTICELNGTEWLPSHFD | 63 | (SEQ ID NO: 342) |
| AAY78550 | 30 | SFADGNGNSSTYQYIYNLTICELNGTDWLSSHFG | 63 | (SEQ ID NO: 343) |
| AAY78551 | 30 | SFVDGNDSSSTYQYIYNLTICELNGTEWLSSHFD | 63 | (SEQ ID NO: 344) |
| AAZ29507 | 28 | LVNANSNSSSHFQLIYNLTLCELNGTDWLANKFD | 61 | (SEQ ID NO: 345) |
| AAZ99127 | 22 | LVNASNDSSSHLQLIYNLTLCELNGTDWLANKFD | 55 | (SEQ ID NO: 346) |
| ABA29588 | 22 | LANASNNSSSHLQLIYNLTLCELNGTDWLANKFD | 55 | (SEQ ID NO: 347) |
| ABA29604 | 22 | LVNASNDSSSHLQLIYNLTLCELNGTDWLANKFD | 55 | (SEQ ID NO: 348) |
| ABB18262 | 28 | LVNADSNSSSHLQLIYXLTICELNGTDWLNNHFS | 61 | (SEQ ID NO: 349) |
| ABB18270 | 28 | LVNASSNSSSHLQLIYNLTICELNGTDWLNDHFS | 61 | (SEQ ID NO: 350) |
| ABB49059 | 28 | LVNASNNSSSHLQLIYNLTLCELNGTDWLANKFD | 61 | (SEQ ID NO: 351) |
| ABB54498 | 28 | LVNANSNSSSHLQLIYNLTLCELNGTDWLAGNFD | 61 | (SEQ ID NO: 352) |
| ABB54503 | 28 | LVNANSNSSSHFQLIYNLTLCELNGTEWLAKKFD | 61 | (SEQ ID NO: 353) |
| ABB54504 | 28 | LVNANSNSSSHFQLIYNLTLCELNGTEWLAKKFD | 61 | (SEQ ID NO: 354) |
| ABB54505 | 28 | LVNANSNSSSHFQLIYNLTLCELNGTEWLANKFD | 61 | (SEQ ID NO: 355) |
| ABB54507 | 28 | LANANSTSSSHFQLIYNLTICELNGTDWLANKFD | 61 | (SEQ ID NO: 356) |
| ABB54512 | 28 | LVSANSNSSSHLQLIYNLTLCELNGTDWLADKFD | 61 | (SEQ ID NO: 357) |
| ABB54513 | 28 | LVNANSTSSSQLQLIYNLTLCELNGTDWLANKFD | 61 | (SEQ ID NO: 358) |
| ABB72824 | 28 | LANASNDSSSHLQLIYNLTLCELNGTDWLANKFD | 61 | (SEQ ID NO: 359) |
| ABC24989 | 28 | LVNASSNSSSHLQLIYNLTICELNGTDWLNDKFD | 61 | (SEQ ID NO: 360) |
| ABC24990 | 28 | LVDASSNSSSHLQLIYNLTICELNGTDWLNNKFD | 61 | (SEQ ID NO: 361) |
| ABC24991 | 28 | LVNAGSNSSSHLQLIYNLTICELNGTDWLNDKFD | 61 | (SEQ ID NO: 362) |
| ABC70887 | 28 | LVNANSNSGSHLQLIYNLTLCELNGTDWLKDKFD | 61 | (SEQ ID NO: 363) |
| ABC70888 | 28 | LVNANNDSSSHLQLIYSLTICELNGTEWLNEHFS | 61 | (SEQ ID NO: 364) |
| ABC74802 | 21 | SFVDGNDSSSTYQYIYNLTICELNGTEWLPTHFD | 54 | (SEQ ID NO: 365) |
| ABC74803 | 21 | SFADGNGNSSTYQYIYNLTICELNGTAWLSTHFD | 54 | (SEQ ID NO: 366) |
| ABC74804 | 21 | SFADGNGNSSTYQYIYNLTICELNGTAWLSTHFD | 54 | (SEQ ID NO: 367) |
| ABC74805 | 21 | SFADGNGNSSTYQYIYDLTLCELNGTDWLSDHFE | 54 | (SEQ ID NO: 368) |
| ABC74806 | 21 | SFADGNGNSSTYQYIYNLTLCELNGTDWLSGHFE | 54 | (SEQ ID NO: 369) |
| ABC74807 | 21 | SFADGNGNSSTYQYIYNLTICELNGTEWLSSHFS | 54 | (SEQ ID NO: 370) |
| ABC74808 | 21 | SFADGNGNSSTYQYIYNLTICELNGTEWLSSHFS | 54 | (SEQ ID NO: 371) |
| ABC74810 | 21 | SFADGNNDSSTYQYIYNLTICELNGTAWLFDHFD | 54 | (SEQ ID NO: 372) |
| ABC74811 | 21 | SFANGNGNSSTYQFIYNMTICELNGTDWLSNNFN | 54 | (SEQ ID NO: 373) |
| ABC74812 | 21 | SFADGNGNSSTYQYIYNLTICELNGTDWLSSHFG | 54 | (SEQ ID NO: 374) |
| ABC74813 | 21 | SFADGNGNSSTFQYIYNLTVCELNGTDWLSGHFS | 54 | (SEQ ID NO: 375) |
| ABC74814 | 21 | SFADGNGNSSTFQYIYNLTVCELNGTDWLSGHFS | 54 | (SEQ ID NO: 376) |
| ABC74816 | 23 | AAANGNSSTLQYIYNLTICELNGTDWLVGKFD | 54 | (SEQ ID NO: 377) |
| ABC74818 | 21 | SFADGNGNSSTYQYIYNLTICELNGTEWLSSNFY | 54 | (SEQ ID NO: 378) |
| ABC74820 | 21 | SFVDGNDNSSTYQYIYNLTICELNGTAWLSSHFD | 54 | (SEQ ID NO: 379) |
| ABC74821 | 21 | SFVDGNDNSSTYQYIYNLTICELNGTAWLSSHFN | 54 | (SEQ ID NO: 380) |
| ABC74822 | 21 | SFADGNGNSSTYQYIYNLTICELNGIQWLSDRFY | 54 | (SEQ ID NO: 381) |
| ABC74823 | 21 | SFAAANGNSSTHQYIYNLTICELNGTDWLQGKFE | 54 | (SEQ ID NO: 382) |
| ABC74824 | 21 | SFADGNGNSSTYQYIYNLTICELNGTAWLFDHFD | 54 | (SEQ ID NO: 383) |
| ABC74826 | 21 | SFADGNGNSSTYQYIYNLTICELNGTKWLTSHFD | 54 | (SEQ ID NO: 384) |
| ABC74827 | 21 | SFADGNGNSSTYQYIYNLTICELNGTEWLTSHFD | 54 | (SEQ ID NO: 385) |
| ABC74828 | 21 | SFADGNGNSSTYQYIYDLTICELNGTNWLASRFS | 54 | (SEQ ID NO: 386) |
| ABC74829 | 21 | SFADGNGNSSTYQYIYNLTICELNGTDWLASHFS | 54 | (SEQ ID NO: 387) |
| ABC74830 | 21 | SFADGNGNSSTYQYIYNLTICELNGTDWLSGHFD | 54 | (SEQ ID NO: 388) |
| ABC74831 | 21 | SFADGNGNSSTYQYIYNLTICELNGTAWLSGHFD | 54 | (SEQ ID NO: 389) |
| ABC75713 | 30 | SFVDGNDDSSTYQYIYNLTICELNGTEWLSSHFD | 63 | (SEQ ID NO: 390) |
| ABC75715 | 30 | SFVDGDNNSSTYQYIYNLTICELNGTNWLSSHFD | 63 | (SEQ ID NO: 391) |
| ABC75716 | 30 | SFADGNGDSSTYQYIYNLTICELNGTAWLSSHFD | 63 | (SEQ ID NO: 392) |

FIG. 3 (con't)

| | | | | |
|---|---|---|---|---|
| ABC75717 | 30 | SFVDGNDDSSTYQYIYNLTICELNGTEWLSSHFD | 63 | (SEQ ID NO: 393) |
| ABC75718 | 30 | SFVDGDDNSSTYQYIYNLTICELNGTNWLSSHFD | 63 | (SEQ ID NO: 394) |
| ABC75719 | 30 | SFADGNGNSSTYQYIYNLTICELNGTDWLSSHFS | 63 | (SEQ ID NO: 395) |
| ABC75720 | 30 | SFADGNGNSSTYQYIYNLTICELNGTDWLSSHFG | 63 | (SEQ ID NO: 396) |
| ABC75721 | 30 | SFADGNGNSSTRQYIYNLTICELNGTTWLTGHFD | 63 | (SEQ ID NO: 397) |
| ABC75722 | 21 | SFADGNGNSSTYQYIYNLTICELNGTDWLSSHFG | 54 | (SEQ ID NO: 398) |
| ABC75723 | 21 | SFADGNGNSSTYQYIYNLTICELNGTAWLSSHFD | 54 | (SEQ ID NO: 399) |
| ABC75724 | 30 | SFADGSGDSSTYQYIYNLTICELNGTAWLSSHFY | 63 | (SEQ ID NO: 400) |
| ABC75725 | 30 | SFVDGNDSSSTYQYIYNLTICELNGTEWLSSHFD | 63 | (SEQ ID NO: 401) |
| ABC75726 | 30 | SFADGNGNSSTYQYIYNLTICELNGTKWLSSHFD | 63 | (SEQ ID NO: 402) |
| ABC75727 | 30 | SFADGNGNSSTYQYIYNLTICELNGTTWLTSHFD | 63 | (SEQ ID NO: 403) |
| ABC75728 | 30 | SFADGNGNSSTYQYIYNLTICELNGTAWLSDHFY | 63 | (SEQ ID NO: 404) |
| ABC75729 | 30 | SFADGNGNSSTYQYIYNLTICELNGTEWLSNHFG | 63 | (SEQ ID NO: 405) |
| ABC75730 | 30 | SFADGSGNSSTYQYIYNLTICELNGTKWLSSHFG | 63 | (SEQ ID NO: 406) |
| ABC75731 | 30 | SFADGNGNGSTYQYIYNLTICELNGTTWLTSHFD | 63 | (SEQ ID NO: 407) |
| ABC75732 | 30 | SFVDGNGNSSTYQYIYNLTICELNGTEWLSSHFD | 63 | (SEQ ID NO: 408) |
| ABC75733 | 30 | SFADGNDNSSTYQYIYNLTICELNGTEWLSSHFG | 63 | (SEQ ID NO: 409) |
| ABC75734 | 30 | SFVDGSDNSSTYQYIYNLTICELNGTHWLSDHFG | 63 | (SEQ ID NO: 410) |
| ABC75735 | 30 | SFADGNGNSSTYLYIYNLTICELNGTLWLSNHFD | 63 | (SEQ ID NO: 411) |
| ABC75736 | 30 | SFADGNGNSSTYQYIYNLTICELNGTAWLSSHFE | 63 | (SEQ ID NO: 412) |
| ABC75737 | 30 | SFADGNGNSSTYQYIYNLTICELNGTEWLSSHFG | 63 | (SEQ ID NO: 413) |
| ABC75738 | 30 | SFADGNGNSSTYQYIYNLTICELNGTEWLASHFD | 63 | (SEQ ID NO: 414) |
| ABC75739 | 30 | SFADGNGNSSTYQYIYNLTICELNGTAWLSSHFD | 63 | (SEQ ID NO: 415) |
| ABC94760 | 1 | DGNGNSSTYQYIYNLTICELNGTDWLSTHFD | 31 | (SEQ ID NO: 416) |
| ABC94763 | 1 | DGNGNSSTYQYIYNLTICELNGTEWLAIHFD | 31 | (SEQ ID NO: 417) |
| ABC94764 | 1 | DGNGNSSTYQYIYNLTICELNGTDWLSNHFG | 31 | (SEQ ID NO: 418) |
| ABC94765 | 1 | DGNGNSSTYQYIYNLTICELNGTDWLSDHFV | 31 | (SEQ ID NO: 419) |
| ABC94766 | 1 | DGNGNSSTYQYIYDLTICELNGTEWLSSHFD | 32 | (SEQ ID NO: 420) |
| ABC94767 | 1 | DGNDNSSTYQYIYKLTICELNGTEWLSSHFD | 31 | (SEQ ID NO: 421) |
| ABC94768 | 1 | DGNDNSSTYQYIYKLTICELNGTEWLSNHFD | 31 | (SEQ ID NO: 422) |
| ABC94769 | 1 | DGNDSSSTYQYIYNLTICELNGTEWLLSHFD | 31 | (SEQ ID NO: 423) |
| ABC94772 | 1 | DGNGNSSTYQYIYNLTICELNGTDWLSSHFV | 31 | (SEQ ID NO: 424) |
| ABC94774 | 1 | DGSGNSSTYQYIYNLTICELNGTTWLSGHFD | 31 | (SEQ ID NO: 425) |
| ABC94776 | 1 | DGNGNSSTYQYIYNLTICELNGTQWLSGHFD | 31 | (SEQ ID NO: 426) |
| ABC94777 | 1 | DGNGNSSTYQYIYNLTICELNGTDWLSDHFG | 31 | (SEQ ID NO: 427) |
| ABD18461 | 28 | LANASSDSSSHLQLIYNLTLCELNGTDWLANKFD | 61 | (SEQ ID NO: 428) |
| ABD59330 | 2 | NSSTYQYIYKLTICELNGTEWLSSHFD | 28 | (SEQ ID NO: 429) |
| ABD59331 | 2 | NSSTYQYIYKLTICELNGTEWLSNHFD | 28 | (SEQ ID NO: 430) |
| ABD59333 | 2 | NSSTYQYIYNLTICELNGTEWLSNHFD | 28 | (SEQ ID NO: 431) |
| ABE02174 | 14 | SFADGNGNSSTYQYIYNLTICELNGTTWLSDHFY | 47 | (SEQ ID NO: 432) |
| ABE02175 | 10 | SFADGNGNSSTYQYIYNLTICELNGTDWLSNHFD | 43 | (SEQ ID NO: 433) |
| ABE02176 | 11 | SFADGNGNSSTYQYIYNLTICELNGTAWLSNKFD | 44 | (SEQ ID NO: 434) |
| ABE02177 | 10 | SFADGNGNSSTYQYIYNLTICELNGTKWLSGHFD | 43 | (SEQ ID NO: 435) |
| ABE02178 | 25 | SSADGNGDSSTYQYIYDLTICELNGTGWLSSHFD | 58 | (SEQ ID NO: 436) |
| ABE02179 | 30 | SFADGNGNSSTYQYIYNLTICELNGTKWLSEHFD | 63 | (SEQ ID NO: 437) |
| ABE02180 | 11 | SFAEGTGNSSTYQYIYDLTICELNGTGWLSTHFD | 44 | (SEQ ID NO: 488) |
| ABE02181 | 16 | SFADGNGNSSTYQYIYNLTICELNGTNWLSGHFD | 49 | (SEQ ID NO: 439) |
| ABE02182 | 12 | SFADGNGNSSTYQYIYNLTICELNGTDWLSNHFY | 45 | (SEQ ID NO: 440) |
| ABE02183 | 1 | ADGNGNSSTYQYIYNLTICELNGTQWLSAHFS | 32 | (SEQ ID NO: 441) |
| ABE02184 | 11 | SFADGNGNSSTYQYIYKLTICELNGTAWLSNHFY | 44 | (SEQ ID NO: 442) |
| ABE69222 | 28 | LVNANSNSSSHLQLIYNLTLCELNGTDWLKDKFD | 61 | (SEQ ID NO: 443) |
| ABE69226 | 28 | FVSANNNSSSHLQLIYNLTLCELNGTDWLANKFD | 61 | (SEQ ID NO: 444) |
| ABE69228 | 28 | LVSASTNSSSHLQLIYNLTLCELNGTDWLANKFD | 61 | (SEQ ID NO: 445) |
| ABE69229 | 29 | VNANSDSSSHFQLIYNLTLCELNGTDWLANKFD | 61 | (SEQ ID NO: 446) |
| ABE69234 | 28 | LVNANSSSSSHFQLIYNLTLCELNGTDWLADKFD | 61 | (SEQ ID NO: 447) |

FIG. 3 (con't)

| | | | | |
|---|---|---|---|---|
| ABE69235 | 28 | IVNATGNSSSHFQLIYNLTLCELNGTDWLANKFD | 61 | (SEQ ID NO: 448) |
| ABE69265 | 28 | LVNASSNNSSHLQLIYNLTICELNGTDWLDKHFS | 61 | (SEQ ID NO: 449) |
| ABE69266 | 28 | LVNADNSSSSHLQLIYNLTICELNGTDWLNEKFD | 61 | (SEQ ID NO: 450) |
| ABE69271 | 28 | IVNANSNSSSHIQLIYNLTLCELNGTDWLAGKFD | 61 | (SEQ ID NO: 451) |
| ABE69273 | 28 | LVNASSNRSSHLQLIYNLTLCELNGTDWLKDKFD | 61 | (SEQ ID NO: 452) |
| ABE69277 | 28 | IVNASGNSSSHFQLIYNLTLCELNGTDWLAKKFD | 61 | (SEQ ID NO: 453) |
| ABE69278 | 28 | LANASNGSSSHLQLIYNLTLCELNGTDWLANKFD | 61 | (SEQ ID NO: 454) |
| ABE69281 | 28 | LANASNDSSSHLQLIYNLTLCELNGTDWLANKFD | 61 | (SEQ ID NO: 455) |
| ABE69282 | 28 | LVNASSNSSSHLQLIYNLTICELNGTDWLNNTFD | 61 | (SEQ ID NO: 456) |
| ABE69289 | 28 | LVNANSNSSSHLQLIYNLTLCELNGTEWLSEKFD | 61 | (SEQ ID NO: 457) |
| ABE69296 | 28 | LANASNDSSSHLQLIYNLTLCELNGTDWLANKFD | 61 | (SEQ ID NO: 458) |
| ABE69299 | 28 | IVNANSNSSSHFQLIYNLTICELNGTDWLKQKFD | 61 | (SEQ ID NO: 459) |
| ABE69300 | 28 | IVNANSNSSSHFQLIYDLTICELNGTDWLSQKFD | 61 | (SEQ ID NO: 460) |
| ABE69313 | 28 | LVNANSNSSSHLQLIYNLTICELNGTDWLNSHFS | 61 | (SEQ ID NO: 461) |
| ABE69315 | 28 | LVNASNGSSSHLQLIYNLTLCELNGTDWLANKFD | 61 | (SEQ ID NO: 462) |
| ABE69316 | 28 | LVDADSNSSSHFQLIYNLTLCELNGTDWLKDKFD | 61 | (SEQ ID NO: 463) |
| ABE69320 | 28 | LVNANSSSSSHFQLIYNLTLCELNGTDWLGNKFD | 61 | (SEQ ID NO: 464) |
| ABE69324 | 28 | LVGANSNSSSHFQLIYNLTLCELNGTDWLGDKFD | 61 | (SEQ ID NO: 465) |
| ABE69327 | 28 | LVGANSNSSSHFQLIYNLTLCELNGTDWLGNKFD | 61 | (SEQ ID NO: 466) |
| ABE69356 | 28 | LVGANSNSSSHFQLIYNLTLCELNGTDWLNDKFS | 61 | (SEQ ID NO: 467) |
| ABE69363 | 28 | LVNANSNSSSHLQLIYNLTICELNGTEWLGNHFS | 61 | (SEQ ID NO: 468) |
| ABE69366 | 28 | LVNASNNSSSHLQLIYNLTICELNGTDWLDKHFS | 61 | (SEQ ID NO: 469) |
| ABE69369 | 28 | LVNANSNSSSHLQLIYNLTLCELNGTDWLKDKFN | 61 | (SEQ ID NO: 470) |
| ABE69370 | 28 | LVNANSNSSSHLQLIYNLTLCELNGTDWLKDKFD | 61 | (SEQ ID NO: 471) |
| ABE69371 | 28 | LVNANSNSSSHLQLIYNLTLCELNGTDWLKDKFD | 61 | (SEQ ID NO: 472) |
| ABE69376 | 28 | LVNANSSSSSHLQLIYNLTLCELNGTDWLKDKFD | 61 | (SEQ ID NO: 473) |
| ABE69383 | 28 | LVNASSNSSSHLQLIYNLTLCELNGTDWLKGKFD | 61 | (SEQ ID NO: 474) |
| ABE69388 | 28 | LVNASSNSSSHLQLIYNLTLCELNGTDWLKDKFD | 61 | (SEQ ID NO: 475) |
| ABE69391 | 28 | LVNANSNSSSHLQLIYNLTLCELNGTDWLKGKFD | 61 | (SEQ ID NO: 476) |
| ABE69395 | 28 | LVGADSNSSSHFQLIYNLTLCELNGTDWLSDKFD | 61 | (SEQ ID NO: 477) |
| ABE69398 | 28 | LVNANSNSSSHLQLIYNLTLCELNGTDWLKDKFD | 61 | (SEQ ID NO: 478) |
| ABE69401 | 28 | LVNASSNSSSHLQLIYNLTLCELNGTDWLKDKFD | 61 | (SEQ ID NO: 479) |
| ABE69405 | 28 | PANAGNNSSSHLQLIYNLTLCELNGTDWLADKFD | 61 | (SEQ ID NO: 480) |
| ABE69411 | 28 | IVNANSNSSSQFQLIYNLTICELNGTDWLADKFD | 61 | (SEQ ID NO: 481) |
| ABE69414 | 28 | LVNADSNNSSHLQLIYNLTICELNGTDWLDNHFS | 61 | (SEQ ID NO: 482) |
| ABE69417 | 28 | IVNANSNSSSHFQLIYNLTICELNGTDWLNHKFD | 61 | (SEQ ID NO: 483) |
| ABE69419 | 28 | LANASNNSSSHLQLIYNLTLCELNGTDWLADKFD | 61 | (SEQ ID NO: 484) |
| ABE69424 | 28 | LVNASSNSSSHFQLIYNLTICELNGTDWLNKKFD | 61 | (SEQ ID NO: 485) |
| ABE69427 | 28 | LVNADSNSSSHLQLIYNLTICELNGTDWLNNHFS | 61 | (SEQ ID NO: 486) |
| ABE69428 | 28 | LVNADSNSSSHLQLIYNLTICELNGTEWLNNHFS | 61 | (SEQ ID NO: 487) |
| ABE69432 | 28 | LVNANSNSSSHLQLIYNLTLCELNGTDWLKNRFD | 61 | (SEQ ID NO: 488) |
| ABE69435 | 28 | LVNANSNSSSHLQLIYNLTICELNGTDWLNNHFS | 61 | (SEQ ID NO: 489) |
| ABE69437 | 28 | LVNANSNSSSHLQLIYNLTICELNGTDWLNNHFS | 61 | (SEQ ID NO: 490) |
| ABE69439 | 28 | LVNANSNSSSHFQLIYNLTLCELNGTDWLADRFD | 61 | (SEQ ID NO: 491) |
| ABE69442 | 28 | LANASNNSSSHLQLIYNLTLCELNGTDWLANKFD | 61 | (SEQ ID NO: 492) |
| ABE69443 | 28 | LVNASNSSSSHLQLIYNLTLCELNGTDWLANKFD | 61 | (SEQ ID NO: 493) |
| ABE69446 | 28 | FVNADSNSSSHLQLIYNLTLCELNGTDWLAQRFD | 61 | (SEQ ID NO: 494) |
| ABE69448 | 28 | LVNASNSSSSHLQLIYNLTICELNGTDWLSHKFD | 61 | (SEQ ID NO: 495) |
| ABE69452 | 28 | LANASNDSSSHLQLIYNLTLCELNGTDWLANKFD | 61 | (SEQ ID NO: 496) |
| ABE69453 | 28 | LANASNNSSSHLQLIYNLTLCELNGTDWLANKFD | 61 | (SEQ ID NO: 497) |
| ABE69456 | 28 | LVNANSASSSHFQLIYNLTLCELNGTDWLNDKFS | 61 | (SEQ ID NO: 498) |
| ABE69458 | 28 | LVNADSNNSSHLQLIYNLTICELNGTDWLNNHFS | 61 | (SEQ ID NO: 499) |
| ABE69462 | 28 | LVNASSNSSSHLQLIYNLTLCELNGTDWLKDKFD | 61 | (SEQ ID NO: 500) |
| ABE69471 | 28 | LVNANSNSSSHFQLIYNLTICELNGTDWLNKKFD | 61 | (SEQ ID NO: 501) |
| ABE69472 | 28 | LVNANSNSSSHLQLIYNLTLCELNGTDWLADKFD | 61 | (SEQ ID NO: 502) |

FIG. 3 (con't)

| | | | | |
|---|---|---|---|---|
| ABE69473 | 28 | LVNANSNSSSHLQLIYNLTLCELNGTDWLADKFD | 61 | (SEQ ID NO: 503) |
| ABE69474 | 28 | LANASNDSSSHLQLIYNLTLCELNGTDWLANKFD | 61 | (SEQ ID NO: 504) |
| ABE69475 | 28 | LVNANSNSSSHLQLIYNLTLCELNGTDWLADKFD | 61 | (SEQ ID NO: 505) |
| ABE69477 | 28 | LVNANSNSSSHLQLIYNLTLCELNGTDWLADKFD | 61 | (SEQ ID NO: 506) |
| ABE69480 | 28 | LVNANSNSSSHLQLIYNLTLCELNGTDWLADKFD | 61 | (SEQ ID NO: 507) |
| ABE69488 | 28 | LANASHNSSSHLQLIYNLTLCELNGTDWLANKFD | 61 | (SEQ ID NO: 508) |
| ABE69489 | 28 | LVNANSSSSSHLQLIYNLTLCELNGTDWLKNKFD | 61 | (SEQ ID NO: 509) |
| ABE69508 | 28 | LVNANSNSSSHLQLIYNLTLCELNGTDWLKDRFD | 61 | (SEQ ID NO: 510) |
| ABE69509 | 28 | LVNANSNSSSHLQLIYNLTLCELNGTDWLKDKFD | 61 | (SEQ ID NO: 511) |
| ABE69512 | 28 | LVNANSNSSSHLQLIYNLTLCELNGTDWLKDKFD | 61 | (SEQ ID NO: 512) |
| ABE69514 | 28 | LVNANSNSSSHLQLIYNLTLCELNGTDWLKNKFD | 61 | (SEQ ID NO: 513) |
| ABE69516 | 28 | LVNANSNSSSHLQLIYNLTLCELNGTDWLKDKFD | 61 | (SEQ ID NO: 514) |
| ABE69517 | 28 | LVGANSNSSSHFQLIYNLTLCELNGTDWLNDKFS | 61 | (SEQ ID NO: 515) |
| ABE69518 | 28 | LVNANSNSSSHLQLIYNLTLCELNGTDWLKDKFN | 61 | (SEQ ID NO: 516) |
| ABE69520 | 28 | LVNANSNSSSHLQLIYNLTLCELNGTDWLKDKFD | 61 | (SEQ ID NO: 517) |
| ABE69523 | 28 | LVGANSNSSSHFQLIYNLTLCELNGTDWLGNKFD | 61 | (SEQ ID NO: 518) |
| ABE69528 | 28 | LVNASSNSSSHLQLIYNLTLCELNGTDWLKNKFD | 61 | (SEQ ID NO: 519) |
| ABE69531 | 28 | FVSANNNSSSHLQLIYNLTLCELNGTDWLANKFD | 61 | (SEQ ID NO: 520) |
| ABE69532 | 28 | LANASNNSSSHLQLIYNLTLCELNGTDWLADKFD | 61 | (SEQ ID NO: 521) |
| ABE69534 | 28 | LANASNESSSHLQLIYNLTLCELNGTDWLANKFD | 61 | (SEQ ID NO: 522) |
| ABE69538 | 28 | IVNASGNSSSHFQLIYNLTLCELNGTDWLADKFD | 61 | (SEQ ID NO: 523) |
| ABE69544 | 28 | LVNANSNSSSHFQSIYNLTLCELNGTDWLADKFD | 61 | (SEQ ID NO: 524) |
| ABE69547 | 28 | PVNADTNNSSKLQLIYNLTLCELNGTDWLADRFN | 61 | (SEQ ID NO: 525) |
| ABE69548 | 28 | IVNANGNSSSHIQLIYNLTLCELNGTBWLAKKFD | 61 | (SEQ ID NO: 526) |
| ABE69553 | 28 | LVNANSTSSSHIQLIYNLTLCELNGTDWLKNKFD | 61 | (SEQ ID NO: 527) |
| ABE69554 | 28 | LVNANSTSSSHIQLIYNLTLCELNGTDWLNNKFD | 61 | (SEQ ID NO: 528) |
| ABE69560 | 28 | LVNANSNSSSHLQLIYNLTLCELNGTDWLKDKFD | 61 | (SEQ ID NO: 529) |
| ABE69561 | 28 | LVNASSNSSSHLQLIYNLTLCELNGTDWLKDKFD | 61 | (SEQ ID NO: 530) |
| ABE69562 | 28 | LVNANSNSSSHLQLIYNLTLCELNGTDWLKDKFD | 61 | (SEQ ID NO: 531) |
| ABE69569 | 29 | VNASSNSSSHFQLIYNLTLCELNGTDWLVNKFD | 61 | (SEQ ID NO: 532) |
| ABE69573 | 28 | LVNASYNNSSHLQLIYNLTLCELNGTDWLANKFD | 61 | (SEQ ID NO: 533) |
| ABE69578 | 28 | LVDANSNSSSHFQLIYNLTLCELNGTDWLANKFD | 61 | (SEQ ID NO: 534) |
| ABE69590 | 28 | LANASNNSSSHLQLIYNLTLCELNGTDWLADKFD | 61 | (SEQ ID NO: 535) |
| ABE69591 | 28 | LANASNGSSSHLQLIYNLTLCELNGTDWLANKFD | 61 | (SEQ ID NO: 536) |
| ABE69599 | 28 | LVNANSNSSSHFQSIYNLTLCELNGTEWLNDHFN | 61 | (SEQ ID NO: 537) |
| ABE69601 | 28 | IVNANSNSSSHFQLIYNLTLCELNGTDWLNKKFD | 61 | (SEQ ID NO: 538) |
| ABE69602 | 28 | IVNANSNSSSHFQLIYNLTLCELNGTDWLNEKFD | 61 | (SEQ ID NO: 539) |
| ABE69604 | 28 | LVNANSSSSSHLQLIYNLTLCELNGTDWLADKFD | 61 | (SEQ ID NO: 540) |
| ABE69614 | 28 | LANASNNSSSHLQLIYNLTLCELNGTDWLANKFD | 61 | (SEQ ID NO: 541) |
| ABE69615 | 28 | IVNASSNSSSHFQLIYNLTLCELNGTDWLANKFD | 61 | (SEQ ID NO: 542) |
| ABE69616 | 28 | LANASNDSSSHLQLIYNLTLCELNGTDWLANKFD | 61 | (SEQ ID NO: 543) |
| ABE69617 | 28 | IVNASSNSSSHFQLIYNLTLCELNGTEWLADKFD | 61 | (SEQ ID NO: 544) |
| ABE69618 | 28 | LVNASANSSSHLQLIYNLTICELNGTDWLGKKFD | 61 | (SEQ ID NO: 545) |
| ABE69623 | 28 | LVNANSTSSSHFQLIYNLTLCELNGTDWLAGKFD | 61 | (SEQ ID NO: 546) |
| ABE69625 | 28 | LANASNDSSSHLQLIYNLTLCELNGTDWLANKFD | 61 | (SEQ ID NO: 547) |
| ABE69627 | 28 | LVNANSNSSSHFQLIYNLTLCELNGTDWLANKFD | 61 | (SEQ ID NO: 548) |
| ABE69628 | 28 | IVNASSNSSSHFQLIYNLTLCELNGTEWLADKFD | 61 | (SEQ ID NO: 549) |
| ABE69629 | 28 | LVNANSNSSSHFQLIYNLTLCELNGTDWLSDKFD | 61 | (SEQ ID NO: 550) |
| ABE69632 | 28 | LVNANSNSSSHFQLIYNLTLCELNGTDWLANKFD | 61 | (SEQ ID NO: 551) |
| ABE69633 | 28 | LVNANSNSSSHLQLIYNLTLCELNGTDWLKDKFD | 61 | (SEQ ID NO: 552) |
| ABE69634 | 28 | LANASNNSSSHLQLIYNLTLCELNGTDWLANKFD | 61 | (SEQ ID NO: 553) |
| ABE69635 | 28 | LVNANNNSSSHLQLIYNLTICELNGTDWLKDKFD | 61 | (SEQ ID NO: 554) |
| ABE69636 | 28 | IVNANSNSSSHFQLIYNLTLCELNGTDWLVDKFD | 61 | (SEQ ID NO: 555) |
| ABE69637 | 28 | LVNANSNSSSHFQLIYNLTLCELNGTDWLSNKFD | 61 | (SEQ ID NO: 556) |
| ABE69639 | 28 | LANASNDSSSHLQLIYNLTLCELNGTDWLANKFD | 61 | (SEQ ID NO: 557) |

FIG. 3 (con't)

| | | | | |
|---|---|---|---|---|
| ABE69640 | 28 | LVDANSNSSSHFQLIYNLTLCELNGTDWLGKKFD | 61 | (SEQ ID NO: 558) |
| ABE69642 | 28 | LVNASSNHSSHLQLIYNLTLCELNGTDWLENKFD | 61 | (SEQ ID NO: 559) |
| ABE69645 | 28 | LVNANSNSSSHFQLIYNLTLCELNGTDWLADKFD | 61 | (SEQ ID NO: 560) |
| ABE69646 | 28 | LVNANSSSSSHFQLIYNLTLCELNGTDWLAKKFD | 61 | (SEQ ID NO: 561) |
| ABE69648 | 28 | LANASNDSSSHLQLIYNLTLCELNGTDWLANKFD | 61 | (SEQ ID NO: 562) |
| ABE69651 | 28 | LANASNNSSSHLQLIYNLTLCELNGTDWLANRFD | 61 | (SEQ ID NO: 563) |
| ABE69653 | 28 | LVNASNNSSSHLQLIYNLTLCELNGTDWLADKFD | 61 | (SEQ ID NO: 564) |
| ABE69654 | 28 | LVNANSSSSSHFQLIYNLTLCELNGTDWLSNKFD | 61 | (SEQ ID NO: 565) |
| ABE69656 | 28 | LVNANSNSSSHLQLIYNLTLCELNGTDWLANRFD | 61 | (SEQ ID NO: 566) |
| ABE69663 | 28 | LVNANSNSSSHFQLIYNLTLCELNGTDWLGNKFD | 61 | (SEQ ID NO: 567) |
| ABE69669 | 28 | LVNANSNSSSHFQLIYNLTLCELNGTDWLTNKFD | 61 | (SEQ ID NO: 568) |
| ABE69671 | 28 | LVNASSNSSSHFQLIYNLTLCELNGTDWLSNKFD | 61 | (SEQ ID NO: 569) |
| ABE69672 | 28 | LVNANSNSSSHFQLIYNLTLCELNGTDWLADKFN | 61 | (SEQ ID NO: 570) |
| ABE69677 | 28 | LVNANSNSSSHFQLIYNLTLCELNGTDWLKEKFD | 61 | (SEQ ID NO: 571) |
| ABE69679 | 28 | LVNANSNSSSHFQLIYNLTLCELNGTDWLAKKFD | 61 | (SEQ ID NO: 572) |
| ABE69690 | 28 | IVNASSNSSSHLQLIYKLTLCELNGTDWLANKFD | 61 | (SEQ ID NO: 573) |
| ABE69693 | 28 | LVNANSNSSSHFQLIYNLTLCELNGTEWLADKFD | 61 | (SEQ ID NO: 574) |
| ABE69695 | 28 | LANASNGSSSHLQLIYNLTLCELNGTDWLANKFD | 61 | (SEQ ID NO: 575) |
| ABE69698 | 30 | SFADGNGNNSTYQYIYNLTICELNGTDWLSGHFD | 63 | (SEQ ID NO: 576) |
| ABE69708 | 28 | IVNANSNSSSHIQLIYNLTLCELNGTDWLAEKFD | 61 | (SEQ ID NO: 577) |
| ABE69723 | 28 | LVNASSNSSSHFQLIYNLTLCELNGTDWLKDKFD | 61 | (SEQ ID NO: 578) |
| ABE69728 | 28 | IVNANSNSSSHLQLIYNLTLCELNGTDWLAKKFD | 61 | (SEQ ID NO: 579) |
| ABE69729 | 28 | LVNASGNSSSHLQLIYNLTLCELNGTDWLANKFD | 61 | (SEQ ID NO: 580) |
| ABE69734 | 28 | LVNASGNSSSHLQLIYNLTICELNGTDWLDKKFD | 61 | (SEQ ID NO: 581) |
| ABE69737 | 28 | LVNANNSSSSHFQLIYNLTLCELNGTDWLAKKFD | 61 | (SEQ ID NO: 582) |
| ABE69742 | 28 | LVNANSNSSSHFQLIYNLTLCELNGTDWLADKFN | 61 | (SEQ ID NO: 583) |
| ABE69743 | 28 | LVNANSNSSSHLQLIYNLTLCELNGTDWLADKFD | 61 | (SEQ ID NO: 584) |
| ABE69744 | 28 | PANADNSSSSHLQLIYNLTLCELNGTDWLANKFD | 61 | (SEQ ID NO: 585) |
| ABE69759 | 28 | LVNANSXSSSHFQLIYNLTLCELNGTDWLAGKFD | 61 | (SEQ ID NO: 586) |
| ABE69760 | 28 | LANADSNSSSHLQLIYNLTLCELNGTDWLANKFD | 61 | (SEQ ID NO: 587) |
| ABE69761 | 28 | LANADSNSSSHLQLIYNLTLCELNGTDWLANKFD | 61 | (SEQ ID NO: 588) |
| ABE69762 | 28 | IVNASNTSSSHFQLIYNMTICELNGTDWLANKFD | 61 | (SEQ ID NO: 589) |
| ABE69764 | 28 | LVNANSNSSSHLQLIYNLTLCELNGTDWLSDKFN | 61 | (SEQ ID NO: 590) |
| ABE69765 | 28 | IVNASSNSSSHFQLIYNLTICELNGTDWLNKKFD | 61 | (SEQ ID NO: 591) |
| ABE69768 | 28 | LVNASNNSSSHLQLIYNLTLCELNGTDWLANKFD | 61 | (SEQ ID NO: 592) |
| ABE69770 | 28 | IVNANSNSSSHFQLIYNLTLCELNGTEWLANKFD | 61 | (SEQ ID NO: 593) |
| ABE69775 | 28 | LVNANSNNSSHFQLIYNLTICELNGTDWLNNKFD | 61 | (SEQ ID NO: 594) |
| ABE69777 | 28 | LVNANSNSSSHFQLIYNLTLCELNGTDWLDKKFD | 61 | (SEQ ID NO: 595) |
| ABE69779 | 28 | LVNASSNSSSHFQLIYNLTLCELNGTDWLAEKFD | 61 | (SEQ ID NO: 596) |
| ABE69780 | 28 | LANASNNSSSHLQLIYNLTLCELNGTDWLANKFD | 61 | (SEQ ID NO: 597) |
| ABE69781 | 28 | LANANSDSSSHLQLIYNLTLCELNGTDWLANKFD | 61 | (SEQ ID NO: 598) |
| ABE69782 | 28 | LANASDDSSSHLQLIYNLTLCELNGTDWLANKFD | 61 | (SEQ ID NO: 599) |
| ABE69783 | 28 | LVNAKSNSSSHLQLIYNLTLCELNGTDWLKNKFD | 61 | (SEQ ID NO: 600) |
| ABE69784 | 28 | LVNANSNSSSHFQLIYNLTICELNGTDWLDEKFD | 61 | (SEQ ID NO: 601) |
| ABE69785 | 28 | LVDASNNSSSHLQLIYNLTLCELNGTDWLANKFD | 61 | (SEQ ID NO: 602) |
| ABE69787 | 28 | LANADSNSSSHLQLIYNLTLCELNGTDWLANKFD | 61 | (SEQ ID NO: 603) |
| ABE69799 | 28 | LVNANSNSSSHLQLIYNLTLCELNGTDWLRNKFD | 61 | (SEQ ID NO: 604) |
| ABE69804 | 28 | LVNANSNSSSHLQLIYNLTLCELNGTDWLNDRFD | 61 | (SEQ ID NO: 605) |
| ABE69805 | 28 | LANASNNSSSHLQLIYNLTLCELNGTDWLANKFD | 61 | (SEQ ID NO: 606) |
| ABE69807 | 28 | LANASNDSSSHLQLIYNLTLCELNGTDWLANKFD | 61 | (SEQ ID NO: 607) |
| ABE69810 | 28 | LVNANSNSSSHFQLIYNLTLCELNGTDWLSDKFD | 61 | (SEQ ID NO: 608) |
| ABE69812 | 28 | LVNANSQNSSHFQLIYNLTLCELNGTDWLVNKFD | 61 | (SEQ ID NO: 609) |
| ABE69813 | 28 | LVNANSNSSSHLQLIYNLTLCELNGTDWLKNKFD | 61 | (SEQ ID NO: 610) |
| ABE69815 | 28 | LVNANSSSSSHFQLIYNLTLCELNGTDWLAEKFD | 61 | (SEQ ID NO: 611) |
| ABE69827 | 28 | LANASNNSSSHLQLIYNLTLCELNGTDWLADRFD | 61 | (SEQ ID NO: 612) |

FIG. 3 (con't)

| | | | | |
|---|---|---|---|---|
| ABE69831 | 28 | LVNANSNSSSHFQLIYNLTLCELNGTEWLAKKFD | 61 | (SEQ ID NO: 613) |
| ABE69839 | 28 | LANAXENSSSHLQLIYNLTLCELNGTDWLANKFD | 61 | (SEQ ID NO: 614) |
| ABE69848 | 28 | LANASNNSSSHLQLIYNLTLCELNGTDWLANKFD | 61 | (SEQ ID NO: 615) |
| ABE69857 | 28 | LANASNNSSSHLQLIYNLTLCELNGTDWLANKFD | 61 | (SEQ ID NO: 616) |
| ABE69865 | 28 | LVNANSNSSSHFQLIYNLTLCELNGTDWLAKNFD | 61 | (SEQ ID NO: 617) |
| ABE69868 | 28 | IVNANSNSSSHFQLIYNLTLCELNGTEWLANKFD | 61 | (SEQ ID NO: 618) |
| ABE69869 | 28 | LANANENSSSHLQLIYNLTLCELNGTDWLANKFD | 61 | (SEQ ID NO: 619) |
| ABE69870 | 28 | LANASNNSSSHLQLIYNLTLCELNGTDWLANRFD | 61 | (SEQ ID NO: 620) |
| ABE69874 | 28 | LVNANSNSSSHFQLIYNLTLCELNGTDWLSKKFD | 61 | (SEQ ID NO: 621) |
| ABE69878 | 28 | LVNAGSNSSSHFQLIYNLTLCELNGTDWLKDKFD | 61 | (SEQ ID NO: 622) |
| ABE69880 | 28 | LVNANSNSSSHFQLIYNLTLCELNGTDWLANKFD | 61 | (SEQ ID NO: 623) |
| ABE69885 | 28 | LVNASSNSSSHFQLIYNLTLCELNGTDWLANKFD | 61 | (SEQ ID NO: 624) |
| ABE69887 | 28 | LVNANSNSSSHLQLIYNLTLCELNGTDWLNDRFD | 61 | (SEQ ID NO: 625) |
| ABE69888 | 28 | LVNANSTSSSHFQLIYNLTLCELNGTEWLANRFD | 61 | (SEQ ID NO: 626) |
| ABE69891 | 28 | LVNANSNSSSHLQLIYNLTLCELNGTDWLAKRFD | 61 | (SEQ ID NO: 627) |
| ABE69899 | 28 | LVNANSNSSSQLQLIYNLTLCELNGTDWLANKFD | 61 | (SEQ ID NO: 628) |
| ABE69901 | 28 | LVNANSNSSSHFQLIYNLTLCELNGTDWLAKKFD | 61 | (SEQ ID NO: 629) |
| ABE69903 | 28 | LVNADSNSSSHLQLIYNLTICELNGTDWLNNHFS | 61 | (SEQ ID NO: 630) |
| ABE69904 | 28 | LVNADSNSSSHLQLIYNLTICELNGTDWLNNHFS | 61 | (SEQ ID NO: 631) |
| ABE69906 | 28 | LVNADSNSSSHLQLIYNLTICELNGTDWLNNHFS | 61 | (SEQ ID NO: 632) |
| ABE69908 | 28 | LVNANSNSSSHLQLIYNLTICELNGTDWLNNHFS | 61 | (SEQ ID NO: 633) |
| ABE69909 | 28 | LVNANSXSSSHLQLIYNLTICELNGTDWLTXHFS | 61 | (SEQ ID NO: 634) |
| ABE69910 | 28 | LVNADSNSSSHLQLIYNLTICELNGTDWLNNHFS | 61 | (SEQ ID NO: 635) |
| ABE69917 | 28 | LVNADSNSSSHLQLIYNLTICELNGTDWLNNHFS | 61 | (SEQ ID NO: 636) |
| ABE69918 | 28 | LVNANSNSSSHFQSIYNLTLCELNGTDWLADKFD | 61 | (SEQ ID NO: 637) |
| ABE69928 | 28 | LVNADSNSSSHLQLIYNLTICELNGTDWLNNHFS | 61 | (SEQ ID NO: 638) |
| ABE69929 | 28 | LANASNNSSSHLQLIYNLTLCELNGTDWLANKFD | 61 | (SEQ ID NO: 639) |
| ABE69934 | 28 | LVNADSNSSSHLQSIYNLXICXLNGTDWLXNHFS | 61 | (SEQ ID NO: 640) |
| ABE69937 | 28 | LVNANSNSSSHFQLIYNLTLCELNGTDWLADKFD | 61 | (SEQ ID NO: 641) |
| ABE69938 | 28 | IVDANSNSSSHFQLIYNLTICELNGTDWLGEKFD | 61 | (SEQ ID NO: 642) |
| ABE69939 | 28 | LVNASNNSSSHLQLIYNLTLCELNGTDWLADRFD | 61 | (SEQ ID NO: 643) |
| ABE69941 | 28 | LVNASNDSSSHLQLIYNLTICELNGTDWLGKKFD | 61 | (SEQ ID NO: 644) |
| ABE69942 | 28 | LVNADSNSSSHLQLIYNLTICELNGTXWLNNHFS | 61 | (SEQ ID NO: 645) |
| ABE69944 | 28 | LVNANSNSSSHFQLIYNLTLCELNGTDWLANNFD | 61 | (SEQ ID NO: 646) |
| ABE69948 | 28 | LANASNDSSSHLQLIYNLTLCELNGTDWLANKFD | 61 | (SEQ ID NO: 647) |
| ABE69949 | 28 | LVNADSNSSSHLQLIYNLTICELNGTDWLNDHFS | 61 | (SEQ ID NO: 648) |
| ABE69950 | 30 | SFADGNGNNSTYQYIYNLTICELNGTKWLSGHFD | 63 | (SEQ ID NO: 649) |
| ABE69951 | 28 | IVNANSBSSSHIQLIYNLTLCELNGTDWLAXKFD | 61 | (SEQ ID NO: 650) |
| ABE69952 | 28 | LANASNNSSSHLQLIYNLTLCELNGTDWLANRFD | 61 | (SEQ ID NO: 651) |
| ABE69955 | 28 | LVNADSNRSSHFQSIYNLTLCELNGTDWLAGKFD | 61 | (SEQ ID NO: 652) |
| ABE69957 | 28 | LVNANSNSSSHFQLIYNLTLCELNGTDWLGNKFD | 61 | (SEQ ID NO: 653) |
| ABE69958 | 28 | LVNANSNSSSHFQLIYNLTLCELNGTDWLKDKFD | 61 | (SEQ ID NO: 654) |
| ABE69959 | 28 | LVNANSNSSSHLQLIYNLTLCELNGTDWLANKFD | 61 | (SEQ ID NO: 655) |
| ABE69963 | 28 | LVDANSNSSSHFQLIYNLTLCELNGTDWLNNKFD | 61 | (SEQ ID NO: 656) |
| ABE69967 | 28 | LVNANSNSSSHLQLIYNLTICELNGTDWLNNHFS | 61 | (SEQ ID NO: 657) |
| ABE69968 | 28 | IVNASGNSSSHFQLIYNLTLCELNGTEWLANKFD | 61 | (SEQ ID NO: 658) |
| ABE69969 | 28 | LANASNNSSSHLQLIYNLTLCELNGTDWLAGKFD | 61 | (SEQ ID NO: 659) |
| ABE69970 | 28 | LANASNNSSSHLQLIYNLTLCELNGTDWLADKFD | 61 | (SEQ ID NO: 660) |
| ABE69971 | 28 | LVNADSNSSSHLQLIYNLTICELNGTDWLNNHFS | 61 | (SEQ ID NO: 661) |
| ABE69973 | 28 | LVNANSNSSSHLQLIYNLTICELNGTDWLNNHFS | 61 | (SEQ ID NO: 662) |
| ABE69979 | 28 | LVNANSNSSSHLQLIYNLTICELNGTEWLNNHFS | 61 | (SEQ ID NO: 663) |
| ABE69984 | 28 | LVNASSNSSSHLQLIYNLTICELNGTDWLNNTFD | 61 | (SEQ ID NO: 664) |
| ABE69988 | 28 | LVNAGSNNSSHLQLIYNLTICELNGTDWLNNHFS | 61 | (SEQ ID NO: 665) |
| ABE69992 | 28 | LVNASNNSSSHLQLIYNMTVCELNGTDWLKNKFD | 61 | (SEQ ID NO: 666) |
| ABE69994 | 28 | LVNASNDSSSHLQLIYNLTLCELNGTDWLADKFD | 61 | (SEQ ID NO: 667) |

FIG. 3 (con't)

| | | | | |
|---|---|---|---|---|
| ABE69999 | 28 | LVNASSNSSSHLQLIYNLTICELNGTDWLNDKFD | 61 | (SEQ ID NO: 668) |
| ABE70001 | 28 | LVNANSSSSSHFQLIYNLTLCELNGTDWLAEKFD | 61 | (SEQ ID NO: 669) |
| ABE70002 | 28 | LVNANSNSSSHFQLIYNLTLCELNGTDWLAKKFD | 61 | (SEQ ID NO: 670) |
| ABE70003 | 28 | LVNANSNSSSHFQLIYNLTLCELNGTDWLAKKFD | 61 | (SEQ ID NO: 671) |
| ABE70005 | 28 | LVNASNNSSSHLQLIYNLTLCELNGTDWLADKFD | 61 | (SEQ ID NO: 672) |
| ABE70006 | 28 | LVDANSNSSSHFQLIYNLTLCELNGTDWLAKKFD | 61 | (SEQ ID NO: 673) |
| ABE70007 | 28 | LVNASSNSSSHFQLIYNLTLCELNGTDWLATKFD | 61 | (SEQ ID NO: 674) |
| ABE70008 | 28 | LVNANSSSSSHLQLIYNLTICELNGTDWLNNHFS | 61 | (SEQ ID NO: 675) |
| ABE70010 | 28 | LVNANSNSSSHFQLIYNLTICELNGTDWLKERFD | 61 | (SEQ ID NO: 676) |
| ABE70012 | 28 | LVNASGNSSSHLQLIYNLTLCELNGTDWLADKFD | 61 | (SEQ ID NO: 677) |
| ABE70027 | 28 | LVNANSNSSSHFQLIYNLTLCELNGTDWLKEKFD | 61 | (SEQ ID NO: 678) |
| ABE70033 | 28 | LVNA-SDSSSHLQLIYNLTICELNGTDWLNNHFS | 60 | (SEQ ID NO: 679) |
| ABE70035 | 28 | LVNASSNSSSHLQLIYNLTICELNGTDWLNNHFS | 61 | (SEQ ID NO: 680) |
| ABE70037 | 28 | LVDANSNSSSHLQLIYNLTLCELNGTDWLADKFD | 61 | (SEQ ID NO: 681) |
| ABE70038 | 28 | LVNASSNSSSHLQLIYNLTICELNGTDWLNDKFD | 61 | (SEQ ID NO: 682) |
| ABE70040 | 28 | LANASNGSSSHLQLIYNLTLCELNGTDWLANKFD | 61 | (SEQ ID NO: 683) |
| ABE70041 | 28 | LVNASSNSSSHLQLIYNLTICELNGTDWLNNHFS | 61 | (SEQ ID NO: 684) |
| ABE70042 | 28 | LVNANSNSSSHFQLIYNLTLCELNGTEWLGKKFD | 61 | (SEQ ID NO: 685) |
| ABE70043 | 28 | LVNANSNSSSHFQLIYNLTLCELNGTDWLAGKFD | 61 | (SEQ ID NO: 686) |
| ABE70044 | 28 | LVNANSNSSSHFQLIYNLTLCELNGTDWLAKNFD | 61 | (SEQ ID NO: 687) |
| ABE70046 | 28 | IVNASSNSSSHFQLIYNLTLCELNGTDWLANKFD | 61 | (SEQ ID NO: 688) |
| ABE70047 | 28 | LVNANSNSSSHFQLIYNLTLCELNGTDWLAKKFD | 61 | (SEQ ID NO: 689) |
| ABE70049 | 28 | LVNANSNSSSHFQLIYNLTLCELNGTDWLGKKFD | 61 | (SEQ ID NO: 690) |
| ABE70057 | 28 | LVDANSNSSSHFQLIYNLTICELNGTDWLEKKFD | 61 | (SEQ ID NO: 691) |
| ABE70061 | 28 | LANASDNSSSHLQLIYNLTLCELNGTDWLANKFD | 61 | (SEQ ID NO: 692) |
| ABE70091 | 28 | LVNANSNHSSHFQLIYNLTLCELNGTEWLANKFD | 61 | (SEQ ID NO: 693) |
| ABE70097 | 28 | LVNAGSNSSSHLQLIYNLTICELNGTDWLNNHFS | 61 | (SEQ ID NO: 694) |
| ABE70102 | 28 | LANANSNSSSHLQLIYNLTLCELNGTDWLAXKFD | 61 | (SEQ ID NO: 695) |
| ABE70103 | 28 | LVNASGNSSSHLQLIYNLTICELNGTDWLNNTFD | 61 | (SEQ ID NO: 696) |
| ABE70106 | 28 | LVNADSNSSSHLQLIYNLTICELNGTDWLNNHFS | 61 | (SEQ ID NO: 697) |
| ABE70110 | 28 | LVNASSNSSSHFQLIYNLTLCELNGTDWLAEKFD | 61 | (SEQ ID NO: 698) |
| ABE70113 | 28 | IVNANGNSSSHFQLIYNLTLCELNGTEWLANKFD | 61 | (SEQ ID NO: 699) |
| ABE70116 | 28 | LVNASSNSSSHFQLIYNLTLCELNGTEWLADKFD | 61 | (SEQ ID NO: 700) |
| ABE70122 | 28 | LVNANSNSSSHFQLIYNLTLCELNGTEWLADKFD | 61 | (SEQ ID NO: 701) |
| ABE70126 | 28 | PVNANKTDSSKLQLIYNLTLCELNGTDWLANKFD | 61 | (SEQ ID NO: 702) |
| ABE70128 | 28 | LVNANGNSSSHFQLIYNLTLCELNGTDWLGKKFD | 61 | (SEQ ID NO: 703) |
| ABE70129 | 28 | LVSANSNSSSHFQLIYNLTLCELNGTDWLAKKFD | 61 | (SEQ ID NO: 704) |
| ABE70145 | 28 | LVNANSXSSSHLQLIYNLTLCELNGTDWLKNKFD | 61 | (SEQ ID NO: 705) |
| ABE70147 | 28 | LVNANSNSSSHLQLIYNLTICELNGTEWLDNHFS | 61 | (SEQ ID NO: 706) |
| ABE70149 | 28 | LVNANSNSSSHLQLIYNLTICELNGTDWLNNHFS | 61 | (SEQ ID NO: 707) |
| ABE70156 | 28 | LVNANSNSSSHFQLIYNLTLCELNGTDWLAXKFD | 61 | (SEQ ID NO: 708) |
| ABE70157 | 28 | LVNANSNSSSHFQLIYNLTLCELNGTDWLAXKFD | 61 | (SEQ ID NO: 709) |
| ABE70158 | 28 | LANASNNSSSHLQLIYNLTLCELNGTDWLADKFD | 61 | (SEQ ID NO: 710) |
| ABE70159 | 28 | LVNASSNSSSHLQLIYNLTICELNGTDWLNNHFS | 61 | (SEQ ID NO: 711) |
| ABE70160 | 28 | LVNANSNSSSHLQLIYNLTICELNGTDWLNNHFS | 61 | (SEQ ID NO: 712) |
| ABE70162 | 28 | LVNANSNSSSHIQLIYNLTLCELNGTEWLSGKFD | 61 | (SEQ ID NO: 713) |
| ABE70165 | 28 | LVNANNDSSSHMQLIYNLTICELNGTDWLANHFG | 61 | (SEQ ID NO: 714) |
| ABE70166 | 28 | IVNANSSSSSHIQLIYNLTLCELNGTDWLADKFD | 61 | (SEQ ID NO: 715) |
| ABE70168 | 28 | LVNADSNSSSHLQLIYNLTICELNGTDWLNNHFS | 61 | (SEQ ID NO: 716) |
| ABE70170 | 28 | LVNASGNSSSHLQLIYNLTICELNGTDWLNDKFD | 61 | (SEQ ID NO: 717) |
| ABE70171 | 28 | LVNANSNSSSHFQLIYNLTLCELNGTDWLGKKFD | 61 | (SEQ ID NO: 718) |
| ABE70172 | 28 | LVNADSNNSSHLQLIYNLTICELNGTDWLNNHFS | 61 | (SEQ ID NO: 719) |
| ABE70174 | 28 | LVNANSNSSSHLQSIYNLTICELNGTDWLNNHFS | 61 | (SEQ ID NO: 720) |
| ABE70178 | 28 | LVNASNNSSSHLQLIYNLTICELNGTDWLGNTFN | 61 | (SEQ ID NO: 721) |
| ABE70179 | 28 | LVNASGNSSSHLQLIYNLTICELNGTDWLNNTFD | 61 | (SEQ ID NO: 722) |

FIG. 3 (con't)

| | | | | |
|---|---|---|---|---|
| ABE70184 | 28 | LVNADSNSSSHLQLIYNLXICELNGTDWLXNHFS | 61 | (SEQ ID NO: 723) |
| ABE70186 | 28 | LVNANSTSSSHFQLIYNLTLCELNGTDWLAGKFD | 61 | (SEQ ID NO: 724) |
| ABE70187 | 28 | LVNADSNSSSHLQLIYNLTICELNGTDWLNNHFS | 61 | (SEQ ID NO: 725) |
| ABE70188 | 28 | LVNANSNSSSHFQLIYNLTLCELNGTDWLAKKFD | 61 | (SEQ ID NO: 726) |
| ABE70191 | 28 | LVNANSNSSSHLQLIYNLTICELNGTDWLNNHFS | 61 | (SEQ ID NO: 727) |
| ABE70192 | 28 | LVNANNTSSSHLQLIYNLTLCELNGTDWLANKFD | 61 | (SEQ ID NO: 728) |
| ABE70194 | 28 | LVNANSNSSSHFQLIYNLTLCELNGTDWLGKKFD | 61 | (SEQ ID NO: 729) |
| ABE70201 | 28 | LVNANSTSSSHFQLIYNLTLCELNGTDWLAGKFD | 61 | (SEQ ID NO: 730) |
| ABE70203 | 28 | LANASNDSSSHLQLIYNLTLCELNGTDWLANKFD | 61 | (SEQ ID NO: 731) |
| ABE70205 | 28 | LVNANSNSSSHLQLIYNLTICELNGTDWLNNHFS | 61 | (SEQ ID NO: 732) |
| ABE70206 | 28 | LVNASSNSSSHLQLIYNLTICELNGTDWLNNHFS | 61 | (SEQ ID NO: 733) |
| ABE70208 | 28 | LVNANSNSSSHLQLIYNLTICELNGTDWLNNTFD | 61 | (SEQ ID NO: 734) |
| ABE70213 | 28 | LVNASGNSSSHLQLIYNLTICELNGTDWLNNTFD | 61 | (SEQ ID NO: 735) |
| ABE70214 | 28 | LVNANSNSSSHFQLIYNLTLCELNGTDWLAEKFD | 61 | (SEQ ID NO: 736) |
| ABE70215 | 28 | LVNASNSSSSHLQLIYNLTLCELNGTDWLADKFD | 61 | (SEQ ID NO: 737) |
| ABE70216 | 28 | LANASANSSSHLQLIYNLTLCELNGTDWLANKFD | 61 | (SEQ ID NO: 738) |
| ABE70221 | 28 | FVNANSNSSSHFQLIYNLTLCELNGTDWLNNKFD | 61 | (SEQ ID NO: 739) |
| ABE70229 | 28 | LVNAHSNSSSHLQLIYNLTICELNGTDWLNRHFS | 61 | (SEQ ID NO: 740) |
| ABE70230 | 28 | LVNASSNSSSHLQLIYNLTICELNGTDWLNNRFS | 61 | (SEQ ID NO: 741) |
| ABE70234 | 28 | LVNASYSSSSHLQLIYNLTLCELNGTDWLANKFD | 61 | (SEQ ID NO: 742) |
| ABE70238 | 28 | LVDANSNSSSHFQLIYNLTICELNGTDWLKEKFD | 61 | (SEQ ID NO: 743) |
| ABE70239 | 28 | LVNASSNSSSHLQLIYNLTICELNGTDWLNNHFS | 61 | (SEQ ID NO: 744) |
| ABE70240 | 28 | LVNASSNSSSHLQLIYNMTVCELNGTDWLKTKFD | 61 | (SEQ ID NO: 745) |
| ABE70241 | 28 | IVNADSNSSSHFQLIYNLTLCELNGTDWLAKKFD | 61 | (SEQ ID NO: 746) |
| ABE70245 | 28 | LVNASSNSSSHLQLIYNLTICELNGTDWLNDHFS | 61 | (SEQ ID NO: 747) |
| ABE70246 | 28 | LVNANSNSSSHFQLIYNLTLCELNGTDWLAKKFD | 61 | (SEQ ID NO: 748) |
| ABE70250 | 28 | LANASNNSSSHLQLIYNLTLCELNGTDWLASKFD | 61 | (SEQ ID NO: 749) |
| ABE70255 | 28 | LVNADSNSSSHLQLIYNLXICELNGTDWLNNHFS | 61 | (SEQ ID NO: 750) |
| ABE70258 | 28 | LVNANSNSSSHLQSIYNLTICELNGTDWLXNHFS | 61 | (SEQ ID NO: 751) |
| ABE70259 | 28 | LANASSDSSSHLQLIYNLTLCELNGTDWLANKFD | 61 | (SEQ ID NO: 752) |
| ABE70260 | 28 | LVNANSNSSSHLQLIYNLTICELNGTDWLNNHFS | 61 | (SEQ ID NO: 753) |
| ABE70261 | 28 | LVNANSNSSSHLQLIYNLTLCELNGTDWLAGKFS | 61 | (SEQ ID NO: 754) |
| ABE70263 | 28 | IVNASSNSSSHFQLIYNLTICELNGTDWLNQKFD | 61 | (SEQ ID NO: 755) |
| ABE70264 | 28 | LVNASNSNSSHLQLIYNLTLCELNGTDWLANKFD | 61 | (SEQ ID NO: 756) |
| ABE70265 | 28 | LVNASNSSSSHLQLIYNLTLCELNGTDWLADKFD | 61 | (SEQ ID NO: 757) |
| ABE70266 | 28 | LVNANSNSSSHFQLIYNLTLCELNGTDWLDKHFY | 61 | (SEQ ID NO: 758) |
| ABE70267 | 28 | LVNASNSSSSHLQLIYNLTICELNGTDWLNNKFD | 61 | (SEQ ID NO: 759) |
| ABE70268 | 28 | LANASDNNSSHLQLIYNLTLCELNGTDWLANKFD | 61 | (SEQ ID NO: 760) |
| ABE70270 | 28 | LVNANSNSSSHLQLIYNLTICELNGTDWLNNHFS | 61 | (SEQ ID NO: 761) |
| ABE70271 | 28 | LVNASNNGSSHLQLIYNLTLCELNGTDWLANKFD | 61 | (SEQ ID NO: 762) |
| ABE70273 | 28 | LVNADSNSSSHLQLIYNLTICELNGTDWLNNHFS | 61 | (SEQ ID NO: 763) |
| ABE70276 | 28 | LVNASGNSSSHLQLIYNLTICELNGTDWLNDKFD | 61 | (SEQ ID NO: 764) |
| ABE70277 | 28 | LANASNNNSSHLQLIYNLTLCELNGTDWLANKFD | 61 | (SEQ ID NO: 765) |
| ABE70278 | 28 | LANASNNNSSHLQLIYNLTLCELNGTDWLANKFD | 61 | (SEQ ID NO: 766) |
| ABE70279 | 28 | LVNANNSSSSHFQLIYNLTLCELNGTDWIANHFS | 61 | (SEQ ID NO: 767) |
| ABE70280 | 28 | LVNANSNSSSHLQLIYNLTICELNGTDWLNEHFS | 61 | (SEQ ID NO: 768) |
| ABE70283 | 28 | LVNASNNSSSHLQLIYNLTICELNGTDWLGNKFD | 61 | (SEQ ID NO: 769) |
| ABE70284 | 28 | LVNADSNSSSHLQLIYNLTICELNGTDWLNNHFS | 61 | (SEQ ID NO: 770) |
| ABE70285 | 28 | LVDADSNSSSHFQLIYNLTLCELNGTDWLKDKFD | 61 | (SEQ ID NO: 771) |
| ABE70287 | 28 | LVNANSNSSSHLQLIYNLTICELNGTEWLDNRFS | 61 | (SEQ ID NO: 772) |
| ABE70288 | 28 | LVNASSNSSSHLQLIYNLTICELNGTDWLNNHFS | 61 | (SEQ ID NO: 773) |
| ABE70291 | 28 | IVNANSNSSSHFQLIYNLTICELNGTDWLNHKFD | 61 | (SEQ ID NO: 774) |
| ABE70292 | 28 | LVNANSNSSSHFQLIYNLTLCELNGTDWLAGKFD | 61 | (SEQ ID NO: 775) |
| ABE70293 | 28 | IVNANSNSSSHFQLIYNLTICELNGTDWLNHKFD | 61 | (SEQ ID NO: 776) |
| ABE70294 | 28 | LVNANSNSSSHFQSIYNLTLCELNGTDWLANKFD | 61 | (SEQ ID NO: 777) |

FIG. 3 (con't)

| | | | | |
|---|---|---|---|---|
| ABE70299 | 28 | LVNANSNSSSHLQLIYNLXICELNGTDWLNNHFS | 61 | (SEQ ID NO: 778) |
| ABE70300 | 28 | LVNANSNSSSHLQLIYNLXICELNGTDWLNNHFS | 61 | (SEQ ID NO: 779) |
| ABE70301 | 28 | LVNANSNSSSHLQLIYNLTICELNGTDWLNNHFS | 61 | (SEQ ID NO: 780) |
| ABE70303 | 28 | IVNANSNSSSHFQLIYNLTICELNGTDWLNQKFD | 61 | (SEQ ID NO: 781) |
| ABE70305 | 28 | LVNADSNNSSHLQLIYNLTICELNGTDWLNNHFS | 61 | (SEQ ID NO: 782) |
| ABE70307 | 28 | LVNANSNSSSHLQLIYNLTICELNGTDWLNNHFS | 61 | (SEQ ID NO: 783) |
| ABE70308 | 28 | LVNADSNSSSHLQLIYNLTICELNGTDWLNNHFS | 61 | (SEQ ID NO: 784) |
| ABE70309 | 28 | LANANNTSSSHLQLIYNLTLCELNGTDWLANKFD | 61 | (SEQ ID NO: 785) |
| ABE70312 | 28 | LVNANSNSSSHFQLIYNLTLCELNGTDWLQGKFD | 61 | (SEQ ID NO: 786) |
| ABE70314 | 28 | LVNADSNSSSHLQLIYNLTICELNGTDWLNNHFS | 61 | (SEQ ID NO: 787) |
| ABE70322 | 28 | LVNANSSSSSHFQLIYNLTLCELNGTDWLANHFD | 61 | (SEQ ID NO: 788) |
| ABE70323 | 28 | LVNADSNSSSHLQLIYNLTICELNGTDWLNNHFS | 61 | (SEQ ID NO: 789) |
| ABE70325 | 28 | LANASTNSSSHLQLIYNLTLCELNGTDWLANKFD | 61 | (SEQ ID NO: 790) |
| ABE70326 | 28 | LANASNDSSSHLQLIYNLTLCELNGTDWLANKFD | 61 | (SEQ ID NO: 791) |
| ABE70329 | 28 | LVNAXSNNSSHLQLIYNLTICELNGTDWLNNHFS | 61 | (SEQ ID NO: 792) |
| ABE70331 | 28 | IVNANSNSSSHFQLIYNLTICELNGTDWLNHKFD | 61 | (SEQ ID NO: 793) |
| ABE70334 | 28 | LVNANSNSSSHFQLIYNLTLCELNGTDWLADKFD | 61 | (SEQ ID NO: 794) |
| ABE70336 | 28 | LVNASSNSSSHLQLIYNLTICELNGTDWLNNHFG | 61 | (SEQ ID NO: 795) |
| ABE70337 | 28 | LVNANSNSSSHLQLIYNLTICXLNGTNWLNNXFS | 61 | (SEQ ID NO: 796) |
| ABE70338 | 28 | LVNASSNSSSHLQLIYSLXICELNGTDWLNNHFG | 61 | (SEQ ID NO: 797) |
| ABE70340 | 28 | LVNAHSNSSSHLQLIYNLTICELNGTDWLNNRFS | 61 | (SEQ ID NO: 798) |
| ABE70341 | 28 | LVNANSNSSSHFQLIYNLTLCELNGTDWLAKKFN | 61 | (SEQ ID NO: 799) |
| ABE70342 | 28 | LVNANSNSSSHLQLIYNLTLCELNGTDWLKDKFD | 61 | (SEQ ID NO: 800) |
| ABE70347 | 28 | LVNANSNSSSHLQLIYNLTICELNGTDWLNNHFS | 61 | (SEQ ID NO: 801) |
| ABE70348 | 28 | LANASGNSSSHLQLIYNLTLCELNGTDWLANKFD | 61 | (SEQ ID NO: 802) |
| ABE70350 | 28 | LVNANSNSSSHLQLIYNLTICELNGTEWLNNQFS | 61 | (SEQ ID NO: 803) |
| ABE70351 | 28 | LVDANSNSSSHFQLIYNLTLCELNGTDWLNNHFT | 61 | (SEQ ID NO: 804) |
| ABE70352 | 28 | LVNANGNSSSHFQLIYNLTLCELNGTDWLENKFD | 61 | (SEQ ID NO: 805) |
| ABE70354 | 28 | LANADSNSSSHLQLIYNLTLCELNGTDWLADKFD | 61 | (SEQ ID NO: 806) |
| ABE70356 | 28 | LANASNNSSSHLQLIYNLTLCELNGTDWLANKFD | 61 | (SEQ ID NO: 807) |
| ABE70361 | 28 | LVSANSNSSSHLQLIYNLTICELNGTDWLNNHFS | 61 | (SEQ ID NO: 808) |
| ABE70363 | 28 | LVNASGNSSSHLQLIYNLTICELNGTDWLNNTFD | 61 | (SEQ ID NO: 809) |
| ABE70367 | 28 | LANASNDSSSHLQLIYNLTLCELNGTDWLANKFD | 61 | (SEQ ID NO: 810) |
| ABE70368 | 28 | LVNANSNSSSHLQLIYNLTICELNGTDWLKDHFS | 61 | (SEQ ID NO: 811) |
| ABE70369 | 28 | LVNAGSNSSSHLQLIYNLTICELNGTDWLKDHFN | 61 | (SEQ ID NO: 812) |
| ABE70372 | 28 | LVNANSNNSSHLQLIYNLTICELNGTDWLBRHFG | 61 | (SEQ ID NO: 813) |
| ABE70376 | 28 | LVNASNSSSSHFQLIYNLTLCELNGTDWLANKFD | 61 | (SEQ ID NO: 814) |
| ABE70377 | 28 | LVNASSNSSSHLQLIYNLTICELNGTDWLNNTFD | 61 | (SEQ ID NO: 815) |
| ABE70378 | 28 | LVNADSNNSSHLQLIYNLTICELNGTDWLNKNFS | 61 | (SEQ ID NO: 816) |
| ABE70379 | 28 | LVNANSNSSSHFQLIYNLTLCELNGTDWLQGKFD | 61 | (SEQ ID NO: 817) |
| ABE70382 | 28 | LVNANSNSSSHLQLIYNLTICELNGTDWLNNHFS | 61 | (SEQ ID NO: 818) |
| ABE70384 | 28 | LVNAGSNSSSHLQLIYNLTICELNGTDWLNDHFS | 61 | (SEQ ID NO: 819) |
| ABE70385 | 28 | LVNADNSSSSYSQLIYNLTLCELNGTDWLANKFD | 61 | (SEQ ID NO: 820) |
| ABE70386 | 28 | LANASNGSSSHLQLIYNLTLCELNGTDWLANKFD | 61 | (SEQ ID NO: 821) |
| ABE70389 | 28 | LVDANSNSSSHLQLIYNLTLCELNGTDWLNNKFD | 61 | (SEQ ID NO: 822) |
| ABE70392 | 28 | LANASNDSSSHLQLIYNLTLCELNGTDWLANKFD | 61 | (SEQ ID NO: 823) |
| ABE70393 | 28 | LVNADSNSSSHLQLIYNLTICELNGTDWLNNHFS | 61 | (SEQ ID NO: 824) |
| ABE70396 | 28 | LVNASSNSSSHLQLIYNLTICELNGTDWLNNHFS | 61 | (SEQ ID NO: 825) |
| ABE70397 | 28 | LVNANSNSSSHLQLIYNLTICELNGTDWLNNHFS | 61 | (SEQ ID NO: 826) |
| ABE70399 | 28 | LVNANSSSSSHIQLIYNLTLCELNGTDWLANKFD | 61 | (SEQ ID NO: 827) |
| ABE70401 | 28 | LVNANSNSSSHLQSIYNLTICELNGTDWLNNHFS | 61 | (SEQ ID NO: 828) |
| ABE70402 | 28 | LVNANSNSSSHLQLIYNLTICELNGTDWLNNHFS | 61 | (SEQ ID NO: 829) |
| ABE70404 | 28 | LVNANSNSSSHFQLIYNLTICELNGTDWLNNHFS | 61 | (SEQ ID NO: 830) |
| ABE70406 | 28 | IVNADSNSSSHLQLIYNLTICELNGTDWLNKKFD | 61 | (SEQ ID NO: 831) |
| ABE70411 | 28 | LVNANSNSSSHLQLIYNLTICELNGTDWLNNHFS | 61 | (SEQ ID NO: 832) |

FIG. 3 (con't)

| | | | | |
|---|---|---|---|---|
| ABE70412 | 28 | LVDANSNSSSHFQLIYNLTLCELNGTDWLNNKFD | 61 | (SEQ ID NO: 833) |
| ABE70413 | 28 | LVNADSNSSSHLQLIYNLTICELNGTDWLKNXFS | 61 | (SEQ ID NO: 834) |
| ABE70416 | 28 | LVNANSSSSSHIQLIYNLTLCELNGTDWLAXKFD | 61 | (SEQ ID NO: 835) |
| ABE70417 | 28 | LVNAHSNSSSHLQLIYNLTICELNGTDWLNNRFS | 61 | (SEQ ID NO: 836) |
| ABE70418 | 28 | LVNADSNSSSHLQLIYNLTICELNGTDWLNNHFG | 61 | (SEQ ID NO: 837) |
| ABE70424 | 28 | LANASNGSSSHLQLIYNLTLCELNGTDWLANKFD | 61 | (SEQ ID NO: 838) |
| ABE70429 | 28 | LVNANNDSSSHLQLIYNLTICELNGTDWLNDHFS | 61 | (SEQ ID NO: 839) |
| ABE70431 | 29 | VNANSNSSSHFQLIYNLTLCELNGTDWLASHFN | 61 | (SEQ ID NO: 840) |
| ABE70432 | 28 | LVNANSNSSSHLQLIYNLTICELNGTDWLNNHFS | 61 | (SEQ ID NO: 841) |
| ABE70435 | 28 | LVNADSNNSSHLQLIYNLTICELNGTDWLNKNFG | 61 | (SEQ ID NO: 842) |
| ABE70436 | 28 | LVNASSNSSSHLQLIYNLTICELNGTDWLNNKFD | 61 | (SEQ ID NO: 843) |
| ABE70439 | 28 | LANANSDSSSHLQLIYNLTLCELNGTDWLANKFD | 61 | (SEQ ID NO: 844) |
| ABE70440 | 28 | LVNAHSNSSSHLQLIYNLTICELNGTDWLNNRFS | 61 | (SEQ ID NO: 845) |
| ABE70441 | 28 | LANANSNSSSHLQLIYNLTLCELNGTDWLABKFD | 61 | (SEQ ID NO: 846) |
| ABE70446 | 28 | LANASNDSSSHLQLIYNLTLCELNGTDWLANKFD | 61 | (SEQ ID NO: 847) |
| ABE70449 | 28 | IVNANSNSSSHIQLIYNLTLCELNGTDWLANKFD | 61 | (SEQ ID NO: 848) |
| ABE70453 | 28 | LVNASSNSSSHLQLIYNLTICELNGTDWLGNEFD | 61 | (SEQ ID NO: 849) |
| ABE70460 | 28 | LVNASSNSSSHLQLIYNLTLCELNGTDWLADRFD | 61 | (SEQ ID NO: 850) |
| ABE70461 | 28 | LVNANSNSSSHLQLIYNLTLCELNGTDWLKDKFD | 61 | (SEQ ID NO: 851) |
| ABE70462 | 28 | LANASNGSSSHLQLIYNLTLCELNGTDWLANKFD | 61 | (SEQ ID NO: 852) |
| ABE70467 | 28 | LVNASSNSSSHFQLIYNLTLCELNGTDWLAEHFD | 61 | (SEQ ID NO: 853) |
| ABE70468 | 28 | LVNASGNSSSHLQLIYNLTICELNGTDWLNNTFD | 61 | (SEQ ID NO: 854) |
| ABE70469 | 28 | LVNANSNSSSHFQLIYNLTICELNGTDWLDQKFD | 61 | (SEQ ID NO: 855) |
| ABE70470 | 28 | LVNADSNSSSHLQLIYNLPICELNGTDWLNNHFS | 61 | (SEQ ID NO: 856) |
| ABE70471 | 28 | LVNASGNSSSHLQLIYNLTICELNGTDWLNDKFD | 61 | (SEQ ID NO: 857) |
| ABE70475 | 28 | LVNANNSSSSHFQLIYNLTLCELNGTDWLANKFD | 61 | (SEQ ID NO: 858) |
| ABE70477 | 28 | PVNANTNNSSKLQLIYNLTLCELNGTDWLADRFN | 61 | (SEQ ID NO: 859) |
| ABE70479 | 28 | LVNANNSSSSHLQLIYNLTLCELNGTDWLADKFD | 61 | (SEQ ID NO: 860) |
| ABE70489 | 28 | LVNANSSSSSHIQLIYNLTLCELNGTDWLADRFD | 61 | (SEQ ID NO: 861) |
| ABE70492 | 28 | LVNANSNSSSHLQLIYNLTLCELNGTDWLRDKFD | 61 | (SEQ ID NO: 862) |
| ABE70494 | 28 | LVNANSNSSSHIQLIYNLTLCELNGTEWLSGKFD | 61 | (SEQ ID NO: 863) |
| ABE70496 | 28 | LANASNDSSSHLQLIYNLTLCELNGTDWLANKFD | 61 | (SEQ ID NO: 864) |
| ABE70497 | 28 | LVNANSNSSSHLQLIYNLTICELNGTDWLNNHFS | 61 | (SEQ ID NO: 865) |
| ABE70502 | 28 | IVNASSNSSSHIQLIYNLTLCELNGTDWLADKFD | 61 | (SEQ ID NO: 866) |
| ABE70505 | 28 | LVNANSNSSSHLQLIYNLTICELNGTDWLNNKFD | 61 | (SEQ ID NO: 867) |
| ABE70509 | 28 | FVSASANSSSHLQLIYNLTICELNGTDWLNEHFG | 61 | (SEQ ID NO: 868) |
| ABE70510 | 28 | LANASNGSSSHLQLIYNLTLCELNGTDWLANKFD | 61 | (SEQ ID NO: 869) |
| ABE70513 | 28 | LDNADSNSSSHLQLIYNLTICELNGTDWLNNHFS | 61 | (SEQ ID NO: 870) |
| ABE70518 | 28 | LANANNDSSSHLQLIYNLTLCELNGTDWLANKFD | 61 | (SEQ ID NO: 871) |
| ABE70519 | 28 | LANASNNSSSHLQLIYNLTLCELNGTDWLADKFD | 61 | (SEQ ID NO: 872) |
| ABE70527 | 28 | LVNASNNSSSHLQLIYNLTICELNGTDWLBNTFD | 61 | (SEQ ID NO: 873) |
| ABE70529 | 28 | LVNASGNSSSHLQLIYNLTICELNGTDWLNNHFS | 61 | (SEQ ID NO: 874) |
| ABE70531 | 28 | LANASNNSSSHLQLIYNLTLCELNGTDWLANKFD | 61 | (SEQ ID NO: 875) |
| ABE70532 | 28 | LVNADSNNSSHLQLIYNLTICELNGTDWLDKHFS | 61 | (SEQ ID NO: 876) |
| ABE70536 | 28 | LANASBNSSSHLQLIYXLTLCELNGTDWLANKFD | 61 | (SEQ ID NO: 877) |
| ABE70541 | 28 | LVNASNNSSSHLQLIYNLTICELNGTDWLNKSFD | 61 | (SEQ ID NO: 878) |
| ABE70546 | 28 | LVNANSSGSSHLQSIYNLTICELNGTDWLNNHFS | 61 | (SEQ ID NO: 879) |
| ABE70555 | 28 | LVNANSNSSSHFQLIYNLTLCELNGTDWLAEKFN | 61 | (SEQ ID NO: 880) |
| ABE70559 | 28 | LANASNDSSSHLQLIYNLTLCELNGTDWLANKFD | 61 | (SEQ ID NO: 881) |
| ABE70561 | 28 | LVNANSNSSSHLQSIYNLTICELNGTHWLNNHFS | 61 | (SEQ ID NO: 882) |
| ABE70565 | 28 | LVNANSNSSSHFQLIYNLTLCELNGTDWLANKFD | 61 | (SEQ ID NO: 883) |
| ABE70571 | 28 | LANASNGSSSHLQLIYNLTLCELNGTDWLANKFD | 61 | (SEQ ID NO: 884) |
| ABE70574 | 28 | LVNANSNSSSHLQLIYNLTICELNGTEWLNNHFS | 61 | (SEQ ID NO: 885) |
| ABE70576 | 28 | LVNASNNNSSHLQLIYNLTICELNGTDWLDKHFS | 61 | (SEQ ID NO: 886) |
| ABE70579 | 28 | LVNASGNSSSHLQLIYNLTICELNGTDWLNNHFS | 61 | (SEQ ID NO: 887) |

FIG. 3 (con't)

| | | | | |
|---|---|---|---|---|
| ABE70582 | 28 | IVNAGSNSSSHIQLIYNLTLCELNGTDWLAGKFD | 61 | (SEQ ID NO: 888) |
| ABE70584 | 28 | LVNANSNSSSHLQLIYNLTICELNGTNWLNNHFS | 61 | (SEQ ID NO: 889) |
| ABE70585 | 28 | LVNASNNNSSHLQLIYNLTICELNGTDWLDKHFS | 61 | (SEQ ID NO: 890) |
| ABE70586 | 28 | LANASNNSSSHLQLIYNLTLCELNGTDWLANKFD | 61 | (SEQ ID NO: 891) |
| ABE70588 | 28 | IVNANSNSSSHFQLIYNLTICELNGTDWLNHKFD | 61 | (SEQ ID NO: 892) |
| ABE70589 | 28 | LVNASGNSSSHFQLIYNLTLCELNGTDWLAEKFD | 61 | (SEQ ID NO: 893) |
| ABE70592 | 28 | LANASANSSSHFQLIYNLTLCELNGTDWLANKFD | 61 | (SEQ ID NO: 894) |
| ABE70596 | 28 | LVNADSNNSSHLQLIYNLTICELNGTDWLDKHFS | 61 | (SEQ ID NO: 895) |
| ABE70600 | 28 | LVNASNNNSSHLQLIYNLTICELNGTDWLDKHFS | 61 | (SEQ ID NO: 896) |
| ABE70601 | 28 | LVNASGNSSSHFQLIYNLTLCELNGTDWLAERFD | 61 | (SEQ ID NO: 897) |
| ABE70604 | 28 | LVNANSTSSSHFQLIYNLTLCELNGTDWLAKKFD | 61 | (SEQ ID NO: 898) |
| ABE70611 | 28 | LVNASGNSSSHFQLIYNLTLCELNGTDWLAKKFD | 61 | (SEQ ID NO: 899) |
| ABE70613 | 28 | LANASNDSSSHLQLIYNLTLCELNGTDWLANKFD | 61 | (SEQ ID NO: 900) |
| ABE70619 | 28 | LVDANSNSSSHFQLIYNLTLCELNGTDWLNNKFD | 61 | (SEQ ID NO: 901) |
| ABE70622 | 28 | LVNASSNSSSHLQLIYNLTICELNGTDWLNNHFS | 61 | (SEQ ID NO: 902) |
| ABE70624 | 28 | LVNADSNHSSHFQSIYNLTLCELNGTDWLAKKFD | 61 | (SEQ ID NO: 903) |
| ABE70628 | 28 | LVNANSNSSSHLQLIYNLTICELNGTDWLNNHFS | 61 | (SEQ ID NO: 904) |
| ABE70629 | 28 | LVNADSNSSSHLQLIYNLTICELNGTDWLNNHFS | 61 | (SEQ ID NO: 905) |
| ABE70630 | 28 | LVNADSNSSSHLQLIYNLTICELNGTEWLNNRFS | 61 | (SEQ ID NO: 906) |
| ABE70632 | 28 | IANANSNSSSHIQLIYNLTLCELNGTDWLAGKFD | 61 | (SEQ ID NO: 907) |
| ABE70633 | 28 | LVNANSNSSSHFQLIYNLTLCELNGTDWLANKFD | 61 | (SEQ ID NO: 908) |
| ABE70635 | 28 | LVNAHSNSSSHLQLIYNLTICELNGTDWLNRHFS | 61 | (SEQ ID NO: 909) |
| ABE70638 | 28 | LVNANSNSSSHIQLIYNLTLCELNGTDWLANKFD | 61 | (SEQ ID NO: 910) |
| ABE70639 | 28 | LANASNDSSSHLQLIYNLTLCELNGTDWLANKFD | 61 | (SEQ ID NO: 911) |
| ABE70640 | 28 | LANASSDSSSHLQLIYNLTLCELNGTDWLANKFD | 61 | (SEQ ID NO: 912) |
| ABE70644 | 28 | LVNADSNNSSHLQLIYNLTICELNGTDWLNNHFS | 61 | (SEQ ID NO: 913) |
| ABE70645 | 28 | LVNANSSSSSHLQLIYNLTLCELNGTDWLKDKFD | 61 | (SEQ ID NO: 914) |
| ABE70646 | 28 | LVNAGSNSSSHLQLIYNLTICELNGTDWLNNHFS | 61 | (SEQ ID NO: 915) |
| ABE70648 | 28 | LVNASNNSSSHLQLIYNLTICELNGTDWLNKSFD | 61 | (SEQ ID NO: 916) |
| ABE70649 | 28 | PVNANSNSSSHLQLIYNLTICELNGTDWLDRKFD | 61 | (SEQ ID NO: 917) |
| ABE70650 | 28 | LVNASGNSSSHFQLIYNLTICELNGTDWLNDHFS | 61 | (SEQ ID NO: 918) |
| ABE70654 | 28 | LVNASSNNSSHLQLIYNLTICELNGTDWLDKHFS | 61 | (SEQ ID NO: 919) |
| ABE70655 | 28 | LVNASSNSSSHLQLIYNLTICELNGTDWLNNHFS | 61 | (SEQ ID NO: 920) |
| ABE70656 | 28 | LVNANSNSSSHLQXIYNLTICELNGTDWLNEHFS | 61 | (SEQ ID NO: 921) |
| ABE70658 | 28 | LVNANNSXSSHLQLIYNLTLCELNGTDWLANKFD | 61 | (SEQ ID NO: 922) |
| ABE70659 | 28 | LVNADSNSSSHLQLIYNLTICELNGTDWLNNHFS | 61 | (SEQ ID NO: 923) |
| ABE70662 | 28 | LVNAGSNSSSHLQLIYNLTICELNGTDWLNDHFS | 61 | (SEQ ID NO: 924) |
| ABE70664 | 28 | LVNASSNSSSHLQLIYNLTICELNGTDWLNNHFS | 61 | (SEQ ID NO: 925) |
| ABE70665 | 28 | LVNADSNSSSHLQLIYNLTICELNGTDWLNNHFS | 61 | (SEQ ID NO: 926) |
| ABE70669 | 28 | LVNADSNSSSHLQLIYNLTICELNGTDWLNNHFS | 61 | (SEQ ID NO: 927) |
| ABE70670 | 28 | LVNASTSSSSHLQLIYNLTICELNGTDWLGNHFS | 61 | (SEQ ID NO: 928) |
| ABE70675 | 28 | LANASNNSSSHLQLIYNLTLCELNGTDWLAGKFD | 61 | (SEQ ID NO: 929) |
| ABE70676 | 28 | LANASSNNSSHLQLIYNLTLCELNGTDWLVNKFD | 61 | (SEQ ID NO: 930) |
| ABE70677 | 28 | LVNASSNSSSHLQLIYNLTICELNGTDWLNNHFS | 61 | (SEQ ID NO: 931) |
| ABE70678 | 28 | PANANNDSSSHLQLIYNLTLCELNGTDWLXNRFD | 61 | (SEQ ID NO: 932) |
| ABE70679 | 28 | LANAHSNSSSHLQLIYNLTICELNGTDWLNKHFS | 61 | (SEQ ID NO: 933) |
| ABE70681 | 28 | LVSANQNNSSHLQLIYNLTLCELNGTDWLANKFD | 61 | (SEQ ID NO: 934) |
| ABE70684 | 28 | LVNASNGSSSHLQLIYNLTLCELNGTDWLATKFD | 61 | (SEQ ID NO: 935) |
| ABE70686 | 28 | LVNASNSSSSHLQLIYNLTICELNGTDWLKNHFS | 61 | (SEQ ID NO: 936) |
| ABE70688 | 28 | IVNASSNSSSHFQLIYNLTICELNGTDWLNQKFD | 61 | (SEQ ID NO: 937) |
| ABE70690 | 29 | VNANANSSSKLQLIYNLTLCELNGTDWLANKFD | 61 | (SEQ ID NO: 938) |
| ABE70693 | 28 | LVNASSNSSSHLQLIYNLTICELNGTDWLENHFS | 61 | (SEQ ID NO: 939) |
| ABE70694 | 28 | LVNASXNSSSHLQLIYNLTICELNGTXWLENHFS | 61 | (SEQ ID NO: 940) |
| ABE70696 | 28 | LVNANSNSSSHLQLIYNLTICELNGTDWLNNHFS | 61 | (SEQ ID NO: 941) |
| ABE70697 | 28 | PVNANSNSSSHLQLIYNLTICELNGTDWLNEHFS | 61 | (SEQ ID NO: 942) |

FIG. 3 (con't)

| | | | | |
|---|---|---|---|---|
| ABE70698 | 28 | LVNANSNSSSHLQLIYNLTICELNGTDWLDKHFS | 61 | (SEQ ID NO: 943) |
| ABE70704 | 28 | LVNANSNSSSHFQLIYKLTLCELNGTDWLAKKFD | 61 | (SEQ ID NO: 944) |
| ABE70705 | 28 | LVNANSNSSSHLQLIYNLTICELNGTDWLNKHFS | 61 | (SEQ ID NO: 945) |
| ABE70707 | 28 | LVNANSNSSSHLQLIYNLTICELNGTEWLNNQFS | 61 | (SEQ ID NO: 946) |
| ABE70711 | 28 | LVNAGSNSSSHLQLIYNLTICELNGTDWLNNHFS | 61 | (SEQ ID NO: 947) |
| ABE70716 | 28 | LVGANSNSSSHFQLIYNLTLCELNGTDWLDNKFD | 61 | (SEQ ID NO: 948) |
| ABE70718 | 28 | LVNAHSNSSSHLQLIYNLTICELNGTDWLNKHFS | 61 | (SEQ ID NO: 949) |
| ABE70721 | 28 | LVNADNNSSSHLQLIYNLTICELNGTDWLNKKFD | 61 | (SEQ ID NO: 950) |
| ABE70722 | 28 | LVNADNNSSSHLQLIYNLTICELNGTEWLNKKFD | 61 | (SEQ ID NO: 951) |
| ABE70724 | 28 | IVNANSNSSSHIQLIYNLTLCELNGTDWLADKFD | 61 | (SEQ ID NO: 952) |
| ABE70725 | 28 | LANAHSNSSSHLQLIYNLTICELNGTDWLNKHFS | 61 | (SEQ ID NO: 953) |
| ABE70727 | 28 | LANASGNSSSHLQLIYNLTLCELNGTDWLANKFD | 61 | (SEQ ID NO: 954) |
| ABE70732 | 28 | LVNADSNSSSHLQLIYNLTICELNGTDWLNNHFS | 61 | (SEQ ID NO: 955) |
| ABE70733 | 28 | LVNADSSNSSHLQLIYNLTICELNGTDWLDRHFS | 61 | (SEQ ID NO: 956) |
| ABE70734 | 28 | LVNASGNSSSHLQLIYNLTICELNGTDWLNNHFS | 61 | (SEQ ID NO: 957) |
| ABE70743 | 28 | LVNAGSNSSSHLQLIYNLTICELNGTEWLBNHFS | 61 | (SEQ ID NO: 958) |
| ABE70745 | 28 | LVNANSSSSSHFQLIYNLTICELNGTDWLNDHFS | 61 | (SEQ ID NO: 959) |
| ABE70752 | 28 | LVDANSNSSSHFQLIYNLTLCELNGTDWLNDKFN | 61 | (SEQ ID NO: 960) |
| ABE70756 | 28 | LVNANSNSSSHLQLIYNLTICELNGTDWLNNHFS | 61 | (SEQ ID NO: 961) |
| ABE70764 | 28 | LVNADSNSSSHLQSIYNLTICELNGTDWLNNHFS | 61 | (SEQ ID NO: 962) |
| ABE70765 | 28 | PANAGDSSSSHLQLIYNLTLCELNGTDWLANKFD | 61 | (SEQ ID NO: 963) |
| ABE70771 | 28 | LANASSDSSSHLQLIYNLTLCELNGTDWLADKFD | 61 | (SEQ ID NO: 964) |
| ABE70773 | 28 | LVNASNNNSSHLQLIYNLTICELNGTDWLNEHFS | 61 | (SEQ ID NO: 965) |
| ABE70775 | 28 | LANAHSNSSSHLQLIYNLTICELNGTDWLNKHFS | 61 | (SEQ ID NO: 966) |
| ABE70779 | 28 | LVNASNNASSHLQLIYNLTICELNGTDWLNKHFS | 61 | (SEQ ID NO: 967) |
| ABE70781 | 28 | LVNANNNSSSHLQLIYNLTICELNGTDWLNDHFR | 61 | (SEQ ID NO: 968) |
| ABE70782 | 28 | LVNANSNSSSHLQLIYNLTICELNGTDWLNKHFS | 61 | (SEQ ID NO: 969) |
| ABE70787 | 28 | LVNANSNSSSHFQLIYNLTLCELNGTDWLATRFD | 61 | (SEQ ID NO: 970) |
| ABE70788 | 28 | LVNASNNTSSHLQLIYNLTICELNGTXWLNKHFN | 61 | (SEQ ID NO: 971) |
| ABE70789 | 28 | LVNANSNSSSHLQLIYNLTICELNGTDWLNKHFS | 61 | (SEQ ID NO: 972) |
| ABE70792 | 28 | IANANSNSSSHIQLIYNLTLCELNGTDWLAGKFD | 61 | (SEQ ID NO: 973) |
| ABE70793 | 28 | LVNAGSNSSSHLQLIYNLTICELNGTGWLNNHFS | 61 | (SEQ ID NO: 974) |
| ABE70798 | 28 | LVNANSNSSSHLQLIYNLTICELNGTDWLNNHFS | 61 | (SEQ ID NO: 975) |
| ABE70802 | 28 | LANASNNSSSHLQLIYNLTLCELNGTDWLANKFD | 61 | (SEQ ID NO: 976) |
| ABE70805 | 28 | LVNASSNNSSHLQLIYNLTICELNGTDWLDKHFS | 61 | (SEQ ID NO: 977) |
| ABE70806 | 28 | LVNANSSSSSHIQLIYNLTLCELNGTDWLANKFD | 61 | (SEQ ID NO: 978) |
| ABE70807 | 28 | LVNAGSNSSSHLQLIYNLTICELNGTDWLNDHFS | 61 | (SEQ ID NO: 979) |
| ABE70810 | 28 | LVNANSNSSSHLQSIYNLTICELNGTDWLNNHFS | 61 | (SEQ ID NO: 980) |
| ABE70812 | 28 | LVNAHSNSSSHLQLIYNLTICELNGTDWLDKHFS | 61 | (SEQ ID NO: 981) |
| ABE70814 | 28 | LANASNDSSSHLQLIYNLTLCELNGTDWLANKFD | 61 | (SEQ ID NO: 982) |
| ABE70818 | 30 | SFADGNGNNSTYQYIYNLTICELNGTNWLSGHFD | 63 | (SEQ ID NO: 983) |
| ABE70823 | 28 | LVNASNNSSSHLQLIYNLTICELNGTEWLNNHFS | 61 | (SEQ ID NO: 984) |
| ABE70824 | 30 | SFADGNGNNSTYQYIYNLTICELNGTDWLSDHFS | 63 | (SEQ ID NO: 985) |
| ABE70825 | 28 | LVNADSNSSSHLQLIYNLTICELNGTDWLNNHFS | 61 | (SEQ ID NO: 986) |
| ABE70828 | 28 | LANAHSNSSSHLQLIYNLTICELNGTDWLDKHFS | 61 | (SEQ ID NO: 987) |
| ABE70829 | 28 | LVNANSSSSSHLQLIYNLTICELNGTDWLKDKFE | 61 | (SEQ ID NO: 988) |
| ABE70834 | 28 | LVNASNNNSSHLQLIYNLTICELNGTDWLNSHFS | 61 | (SEQ ID NO: 989) |
| ABE70835 | 28 | LVNANSNSSSHLQLIYNLTICELNGTEWLNNKFS | 61 | (SEQ ID NO: 990) |
| ABE70836 | 28 | LVNANSNSSSHLQLIYNLTICELNGTDWLNNHFS | 61 | (SEQ ID NO: 991) |
| ABE70837 | 28 | LVNANSNSSSHFQLIYNLTLCELNGTDWLNKKFD | 61 | (SEQ ID NO: 992) |
| ABE70838 | 28 | LVNANGNSSSHFQLIYNLTLCELNGTEWLGNKFD | 61 | (SEQ ID NO: 993) |
| ABE70839 | 28 | LVNANSNSSSHFQSIYNLTLCELNGTDWLAGKFD | 61 | (SEQ ID NO: 994) |
| ABE70840 | 28 | LVDANSNSSSHFQLIYNLTICELNGTDWLKEKFD | 61 | (SEQ ID NO: 995) |
| ABE70841 | 28 | LVNASNNSSSHLQLIYNLTICELNGTDWLNNHFS | 61 | (SEQ ID NO: 996) |
| ABE70843 | 28 | LVNANSNSSSHFQLIYNLTLCELNGTDWLAGKFD | 61 | (SEQ ID NO: 997) |

FIG. 3 (con't)

| | | | | |
|---|---|---|---|---|
| ABE70846 | 28 | LVNANSNSSSHIQLIYNLTLCELNGTDWLANKFD | 61 | (SEQ ID NO: 998) |
| ABE70848 | 28 | LVNA-SNSSSHFQLIYNLTLCELNGTDWLANKFD | 60 | (SEQ ID NO: 999) |
| ABE70850 | 28 | IVNASSNSSSHIQLIYNLTICELNGTDWLNYKFD | 61 | (SEQ ID NO: 1000) |
| ABE70856 | 28 | LVDANSNSSSHLQLIYNLTICELNGTDWLKNNFD | 61 | (SEQ ID NO: 1001) |
| ABE70859 | 28 | LVNANSNSSSHFQLIYNLTLCELNGTDWLAERFD | 61 | (SEQ ID NO: 1002) |
| ABE70860 | 28 | LVNASNNSSSHLQLIYNLTICELNGTDWLNNHFS | 61 | (SEQ ID NO: 1003) |
| ABE70865 | 28 | LVNANSNSSSHIQLIYNLTLCELNGTDWLANKFD | 61 | (SEQ ID NO: 1004) |
| ABE70873 | 28 | LVNANSTSSSHFQLIYNLTLCELNGTDWLANKFD | 61 | (SEQ ID NO: 1005) |
| ABE70875 | 28 | LVNASSNSSSHFQLIYNLTLCELNGTDWLANKFD | 61 | (SEQ ID NO: 1006) |
| ABE70876 | 28 | LVNANSNNSSHLQLIYNLTICELNGTDWLDKKFD | 61 | (SEQ ID NO: 1007) |
| ABE70877 | 28 | LVNASNNSSSHLQLIYNLTICELNGTDWLNDKFD | 61 | (SEQ ID NO: 1008) |
| ABE70887 | 28 | LVNASSNNSSHLQLIYNLTICELNGTDWLDKRFS | 61 | (SEQ ID NO: 1009) |
| ABE70888 | 28 | LVNASSNSSSHLQLIYNLTICELNGTDWLNDHFS | 61 | (SEQ ID NO: 1010) |
| ABE70890 | 28 | LANASNNSSSHLQLIYNLTLCELNGTDWLADKFD | 61 | (SEQ ID NO: 1011) |
| ABE70891 | 28 | LVNASGNSSSHFQLIYNLTICELNGTEWLDDHFS | 61 | (SEQ ID NO: 1012) |
| ABE70896 | 28 | LVNADSNSSSHLQLIYNLTICELNGTDWLNKNFS | 61 | (SEQ ID NO: 1013) |
| ABE70899 | 28 | LVNANSNSSSHLQLIYNLTLCELNGTDWLKDKFD | 61 | (SEQ ID NO: 1014) |
| ABE70900 | 28 | LVNASNSSSSHLQLIYNLTICELNGTDWLKNHFS | 61 | (SEQ ID NO: 1015) |
| ABE70901 | 28 | LANANSNSSSHLQLIYNLTLCELNGTDWLVGKFD | 61 | (SEQ ID NO: 1016) |
| ABE70905 | 28 | LVNANSNSSSHLQLIYNLTICELNGTDWLNDKFD | 61 | (SEQ ID NO: 1017) |
| ABE70907 | 28 | LVNANSNSSSHLQLIYNLTLCELNGTDWLKDKFD | 61 | (SEQ ID NO: 1018) |
| ABE70908 | 28 | LVNANSNSSSHLQLIYNLTICELNGTDWLNEHFS | 61 | (SEQ ID NO: 1019) |
| ABE70909 | 28 | LVNATSNSSSHLQLIYNLTLCELNGTDWLGEKFD | 61 | (SEQ ID NO: 1020) |
| ABE70910 | 28 | LVNASSNNSSHLQLIYNLTICELNGTEWLNNHFS | 61 | (SEQ ID NO: 1021) |
| ABE70912 | 28 | LVNANSNSSSHLQLIYNLTICELNGTDWLKNHFS | 61 | (SEQ ID NO: 1022) |
| ABE70914 | 28 | LVNANGNSSSHLQLIYNLTLCELNGTDWLAKRFD | 61 | (SEQ ID NO: 1023) |
| ABE70915 | 28 | LVNANSNSSSHFQLIYNLTLCELNGTDWLANKFD | 61 | (SEQ ID NO: 1024) |
| ABE70916 | 28 | LVNANSNSSSHLQLIYNLTICELNGTDWLYNHFS | 61 | (SEQ ID NO: 1025) |
| ABE70918 | 28 | LVNASGNSSSHLQLIYNLTICELNGTEWLGNHFS | 61 | (SEQ ID NO: 1026) |
| ABE70920 | 28 | LVNANSNSSSHLQLIYNLTLCELNGTDWLKDKFD | 61 | (SEQ ID NO: 1027) |
| ABE70921 | 28 | LVNANSNSSSHLQLIYNLTLCELNGTDWLRNKFD | 61 | (SEQ ID NO: 1028) |
| ABE70926 | 28 | LVNASSNSSSHLQLIYNLTICELNGTDWLDKRFD | 61 | (SEQ ID NO: 1029) |
| ABE70927 | 28 | LVNANSNSSSHIQLIYNLTLCELNGTDWLANKFD | 61 | (SEQ ID NO: 1030) |
| ABE70928 | 28 | LVNASNNSSSHLQLIYNLTICELNGTDWLNEHFS | 61 | (SEQ ID NO: 1031) |
| ABE70929 | 28 | LVNAGSNSSSHLQLIYNLTICELNGTDWLNNHFS | 61 | (SEQ ID NO: 1032) |
| ABE70930 | 28 | LVNAXXNSSSHLQLIYNLTICELNGTDWLNNHFS | 61 | (SEQ ID NO: 1033) |
| ABE70931 | 28 | LVNASSNSSSHLQLIYNLTICELNGTDWLNNHFS | 61 | (SEQ ID NO: 1034) |
| ABE70933 | 28 | LVNAGSNSSSHLQLIYNLTICELNGTDWLXDHFS | 61 | (SEQ ID NO: 1035) |
| ABE70934 | 28 | IVNASNDSSSHLQLIYNLTICELNGTEWLNNHFS | 61 | (SEQ ID NO: 1036) |
| ABE70936 | 28 | LVNANSBSSSHIQLIYNLTLCELNGTDWLANKFD | 61 | (SEQ ID NO: 1037) |
| ABE70937 | 28 | LVNANSNSSSHLQLIYKLTICELNGTDWLNEHFS | 61 | (SEQ ID NO: 1038) |
| ABE70943 | 28 | LVNASGNSSSHFQLIYNLTLCELNGTDWLADKFD | 61 | (SEQ ID NO: 1039) |
| ABE70944 | 28 | LVNAHSNSSSHLQLIYNLTICELNGTDWLNNHFS | 61 | (SEQ ID NO: 1040) |
| ABE70947 | 28 | LVNANSNSSSHLQLIYNLTICELNGTDWLNNXFS | 61 | (SEQ ID NO: 1041) |
| ABE70952 | 28 | LANASNNSSSHLQLIYNLTLCELNGTDWLADKFD | 61 | (SEQ ID NO: 1042) |
| ABE70953 | 28 | LVNANNTSSSHFQLIYNLTLCELNGTDWLANKFD | 61 | (SEQ ID NO: 1043) |
| ABE70954 | 28 | LVNADSNSSSHLQLIYNLTICELNGTDWLNNHFS | 61 | (SEQ ID NO: 1044) |
| ABE70956 | 28 | LVNANSNSSSHLQLIYNLTICELNGTDWLNNRFS | 61 | (SEQ ID NO: 1045) |
| ABE70967 | 28 | LVNANSNSSSHFQLIYNLTICELNGTDWLSNKFD | 61 | (SEQ ID NO: 1046) |
| ABE70972 | 28 | LVNANSNSSSHLQLIYNLTICELNGTDWLDKHFS | 61 | (SEQ ID NO: 1047) |
| ABE70981 | 28 | LVNASSNSSSHLQLIYNLTICELNGTDWLNDHFS | 61 | (SEQ ID NO: 1048) |
| ABE70982 | 28 | LVNANNNSSSHLQLIYNLTICELNGTDWLNKSFD | 61 | (SEQ ID NO: 1049) |
| ABE70984 | 28 | LVNANSNSSSHFQLIYNLTLCELNGTDWLQGKFD | 61 | (SEQ ID NO: 1050) |
| ABE70986 | 28 | LVNANSNSSSHLQLIYNLTLCELNGTDWLKDKFD | 61 | (SEQ ID NO: 1051) |
| ABE70987 | 28 | LVNANSNSSSHFQLIYNLTLCELNGTEWLGNKFD | 61 | (SEQ ID NO: 1052) |

FIG. 3 (con't)

| | | | | |
|---|---|---|---|---|
| ABE70989 | 28 | LVNANSNSSSHLQLIYNLTICELNGTDWLNNHFS | 61 | (SEQ ID NO: 1053) |
| ABE70991 | 28 | LVNAHSNSSSHLQLIYNLTICELNGTEWLNNHFS | 61 | (SEQ ID NO: 1054) |
| ABE70992 | 28 | LVNADSNSSSHLQLIYNLTICELNGTDWLNNHFS | 61 | (SEQ ID NO: 1055) |
| ABE70997 | 28 | LANANSNSSSHLQLIYNLTLCELNGTDWLADKFD | 61 | (SEQ ID NO: 1056) |
| ABE71000 | 28 | LVNASNDSSSHLQLIYNLTICELNGTDWLNNKFD | 61 | (SEQ ID NO: 1057) |
| ABE71001 | 28 | LVNANSNSSSHFQLIYNLTICELNGTDWLNEHFS | 61 | (SEQ ID NO: 1058) |
| ABE71003 | 28 | LVNASSNSSSHLQLIYNLTICELNGTDWLNDHFS | 61 | (SEQ ID NO: 1059) |
| ABE71005 | 28 | LVNASSNSSSHLQLIYNLTICELNGTDWLNNHFS | 61 | (SEQ ID NO: 1060) |
| ABE71010 | 28 | LVNASGNSSSHLQLIYNLTICELNGTDWLNNKFD | 61 | (SEQ ID NO: 1061) |
| ABE71016 | 28 | LVNAESNSSSHFQLIYNLTICELNGTDWLNNHFS | 61 | (SEQ ID NO: 1062) |
| ABE71017 | 28 | LVNANSNSSSHFQLIYNLTLCELNGTDWLNNKFD | 61 | (SEQ ID NO: 1063) |
| ABE71028 | 28 | LVNANSXSSSHLQLIYNLTICELNGTDWLNNHFS | 61 | (SEQ ID NO: 1064) |
| ABE71029 | 28 | IVNASSNSSSHFQLIYNLTLCELNGTDWLANKFD | 61 | (SEQ ID NO: 1065) |
| ABE71035 | 28 | LVNADSNSSSHLQLIYNLTICELNGTBWLXNHFS | 61 | (SEQ ID NO: 1066) |
| ABE71042 | 28 | LVNASGNSSSHLQLIYNLTICELNGTDWLNNHFS | 61 | (SEQ ID NO: 1067) |
| ABE71045 | 28 | LANASNGSSSHLQLIYNLTLCELNGTDWLANKFD | 61 | (SEQ ID NO: 1068) |
| ABE71054 | 28 | LVNANNNSSSHLQLIYNLTICELNGTDWLNNTFD | 61 | (SEQ ID NO: 1069) |
| ABE71062 | 28 | LVNADSNSSSHLQSIYNLTICELNGTDWLNNHFS | 61 | (SEQ ID NO: 1070) |
| ABE71063 | 28 | LVNANSDSSSHLQLIYNLTICELNGTDWLNEHFS | 61 | (SEQ ID NO: 1071) |
| ABE71064 | 28 | LVNADSNSSSHLQLIYNLTICELNGTEWLNNHFS | 61 | (SEQ ID NO: 1072) |
| ABE71069 | 28 | LVNANSSNSSHLQLIYNLTICELNGTDWLNNHFS | 61 | (SEQ ID NO: 1073) |
| ABE71071 | 28 | LVNANSNSSSHLQLIYNLTICELNGTDWLNNHFS | 61 | (SEQ ID NO: 1074) |
| ABE71076 | 28 | LVNASSNSSSHLQLIYNLTICELNGTDWLNNHFS | 61 | (SEQ ID NO: 1075) |
| ABE71085 | 28 | LVNAGSNSSSHLQLIYNLTICELNGTGWLNDHFS | 61 | (SEQ ID NO: 1076) |
| ABE71091 | 28 | LVSANNSSSSHLQLIYNMTLCELNGTDWLASRFD | 61 | (SEQ ID NO: 1077) |
| ABE71093 | 28 | LVNASNNSSSHLQLIYNLTICELNGTGWLNEHFS | 61 | (SEQ ID NO: 1078) |
| ABE71094 | 28 | LVNANSNSSSHLQLIYNLTLCELNGTDWLKDKFD | 61 | (SEQ ID NO: 1079) |
| ABE71095 | 28 | LVNANSSSSSHFQLIYNLTLCELNGTDWLAQKFD | 61 | (SEQ ID NO: 1080) |
| ABE71100 | 28 | LVNASSNSSSHLQLIYNLTLCELNGTDWLKDKFD | 61 | (SEQ ID NO: 1081) |
| ABE71102 | 28 | LVNANSNSSSHLQLIYNLTICELNGTDWLNNHFS | 61 | (SEQ ID NO: 1082) |
| ABE71103 | 28 | LVNADNNSSSHLQLIYNLTICELNGTDWLNEKFD | 61 | (SEQ ID NO: 1083) |
| ABE71105 | 28 | LANASDNSSSHLQLIYNLTLCELNGTDWLAGKFD | 61 | (SEQ ID NO: 1084) |
| ABE71109 | 28 | LVNASGNSSSHFQLIYNLTLCELNGTDWLADKFD | 61 | (SEQ ID NO: 1085) |
| ABE71113 | 28 | IVNANSNSSSQFQLIYNLTICELNGTDWLADKFD | 61 | (SEQ ID NO: 1086) |
| ABE71114 | 28 | LVNANSSSSSHLQLIYNLTLCELNGTDWLQDKFD | 61 | (SEQ ID NO: 1087) |
| ABE71116 | 28 | LVNANSDSSSHLQLIYNLTICELNGTDWLGNKFD | 61 | (SEQ ID NO: 1088) |
| ABE71117 | 28 | LVNANSNSSSHIQLIYNLTLCELNGTDWLANEFD | 61 | (SEQ ID NO: 1089) |
| ABE71120 | 28 | LVNASNDSSSHLQLIYNLTICELNGTDWLNEHFS | 61 | (SEQ ID NO: 1090) |
| ABE71121 | 28 | LVNASSNSSSHLQLIYNLTICELNGTDWLNDHFS | 61 | (SEQ ID NO: 1091) |
| ABE71125 | 28 | LVNANQNSSSHLQLIYNLTICELNGTDWLRDKFN | 61 | (SEQ ID NO: 1092) |
| ABE71127 | 28 | LVNANSSSSSHLQLIYNLTLCELNGTDWLGDKFD | 61 | (SEQ ID NO: 1093) |
| ABE71129 | 28 | LVNANSSSSSHLQLIYNLTICELNGTDWLDGHFS | 61 | (SEQ ID NO: 1094) |
| ABE71132 | 28 | LVNASSNSSSHLQLIYNLTLCELNGTDWLKNKFD | 61 | (SEQ ID NO: 1095) |
| ABE71137 | 28 | LVNASNNNSSHLQLIYNLTICELNGTEWLNDHFS | 61 | (SEQ ID NO: 1096) |
| ABE71139 | 28 | LVNANSNSSSHFQLIYNLTLCELNGTEWLGSKFD | 61 | (SEQ ID NO: 1097) |
| ABE71141 | 28 | LVNASSDNSSHLQLIYNLTICELNGTDWLDKHFS | 61 | (SEQ ID NO: 1098) |
| ABE71143 | 28 | LVNANSNSSSHLQSIYNLTICELNGTDWLNNRFS | 61 | (SEQ ID NO: 1099) |
| ABE71144 | 28 | LVNASSNSSSHLQLIYNLTICELNGTDWLDNHFS | 61 | (SEQ ID NO: 1100) |
| ABE71153 | 28 | LVNANSNSSSHLQLIYNLTLCELNGTDWLRDKFG | 61 | (SEQ ID NO: 1101) |
| ABE71156 | 28 | LVNASSNSSSHLQLIYNLTICELNGTDWLNNHFS | 61 | (SEQ ID NO: 1102) |
| ABE71158 | 28 | LVNAGSNSSSHLQLIYNLTICELNGTDWLNDHFS | 61 | (SEQ ID NO: 1103) |
| ABE71159 | 28 | LVNANSNSSSHLQLIYNLTICELNGTDWLDGHFS | 61 | (SEQ ID NO: 1104) |
| ABE71160 | 28 | LVNASNNSSSHLQLIYNLTICELNGTDWLNKSFD | 61 | (SEQ ID NO: 1105) |
| ABE71162 | 28 | LVNASSNSSSHLQLIYNLTICELNGTDWLNDHFS | 61 | (SEQ ID NO: 1106) |
| ABE71164 | 28 | LVNAKGNSSSHLQLIYNLTLCELNGTDWLKDKFD | 61 | (SEQ ID NO: 1107) |

FIG. 3 (con't)

| | | | | |
|---|---|---|---|---|
| ABE71165 | 28 | LVNASSNSSSHLQLIYNLTICELNGTDWLNNHFS | 61 | (SEQ ID NO: 1108) |
| ABE71167 | 28 | LVNANSSHSSHFQLIYNLTLCELNGTDWLANKFD | 61 | (SEQ ID NO: 1109) |
| ABE71168 | 28 | IVNANSTSSSHLQLIYNLTLCELNGTDWLADKFD | 61 | (SEQ ID NO: 1110) |
| ABE71171 | 28 | LVNASNNSSSHLQLIYNLTICELNGTDWLNKSFD | 61 | (SEQ ID NO: 1111) |
| ABE71177 | 28 | LVNASNSSSSHLQLIYNLTLCELNGTDWLADKFD | 61 | (SEQ ID NO: 1112) |
| ABE71180 | 28 | LVNANSNSSSHLQLIYNLTICELNGTDWLNSHFS | 61 | (SEQ ID NO: 1113) |
| ABE71182 | 28 | LVNANSNSSSHLQLIYNLTLCELNGTDWLKNKFD | 61 | (SEQ ID NO: 1114) |
| ABE71184 | 28 | LVNASNNSSSHLQLIYNLTLCELNGTDWLANNFD | 61 | (SEQ ID NO: 1115) |
| ABE71190 | 28 | LVNANSNSSSHFQLIYNLTLCELNGTDWLGKKFD | 61 | (SEQ ID NO: 1116) |
| ABE71191 | 28 | LANAHSNSSSHLQLIYNLTICELNGTDWLDKHFS | 61 | (SEQ ID NO: 1117) |
| ABE71193 | 28 | LVNASNNNSSHLQLIYNLTICELNGTDWLNKHFS | 61 | (SEQ ID NO: 1118) |
| ABE71195 | 28 | LVNASNNSSSHLQLIYNLTICELNGTDWLNERFN | 61 | (SEQ ID NO: 1119) |
| ABE71196 | 28 | LANASNNSSSHLQLIYNLTLCELNGTDWLANRFD | 61 | (SEQ ID NO: 1120) |
| ABE71197 | 28 | LVNASGNSSSHLQLIYNLTICELNGTDWLNDHFS | 61 | (SEQ ID NO: 1121) |
| ABE71200 | 28 | LVNANSNSSSHLQLIYNLTLCELNGTDWLANKFD | 61 | (SEQ ID NO: 1122) |
| ABE71207 | 28 | LVNANSNSSSHLQLIYNLTICELNGTDWLNNHFS | 61 | (SEQ ID NO: 1123) |
| ABE71209 | 28 | LVNASDNNSSHLQLIYNLTICELNGTDWLNKHFS | 61 | (SEQ ID NO: 1124) |
| ABE71213 | 28 | LVNANSNSSSHFQLIYNLTLCELNGTDWLAGKFD | 61 | (SEQ ID NO: 1125) |
| ABE71215 | 28 | LANASNNSSSHLQLIYNLTLCELNGTDWLANKFD | 61 | (SEQ ID NO: 1126) |
| ABE71218 | 28 | LVNANSNSSSHFQLIYNLTLCELNGTDWLRDKFD | 61 | (SEQ ID NO: 1127) |
| ABE71223 | 28 | LVNANSNSSSHLQLIYNLTICELNGTDWLDSHFS | 61 | (SEQ ID NO: 1128) |
| ABE71226 | 28 | LVNANSNSSSHLQSIYNLTICELNGTDWLNNHFS | 61 | (SEQ ID NO: 1129) |
| ABE71227 | 28 | LANAHSNSSSHLQLIYNLTICELNGTDWLNRHFS | 61 | (SEQ ID NO: 1130) |
| ABE71232 | 28 | LANAQSNSSSHLQLIYNLTICELNGTDWLNRHFS | 61 | (SEQ ID NO: 1131) |
| ABE71239 | 30 | SFADGNGNNSTYQYIYNLTICELNGTNWLSDHFE | 63 | (SEQ ID NO: 1132) |
| ABE71240 | 28 | LANANNDSSSHLQLIYNLTLCELNGTDWLANKFD | 61 | (SEQ ID NO: 1133) |
| ABE71245 | 28 | LVXANSNSSSHLQLIYNLTICELNGTDWLNDKFN | 61 | (SEQ ID NO: 1134) |
| ABE71248 | 28 | LVNANRNSSSHLQLIYNLTLCELNGTDWLKDKFD | 61 | (SEQ ID NO: 1135) |
| ABE71250 | 28 | LANASNGSSSHLQLIYNLTLCELNGTDWLANKFD | 61 | (SEQ ID NO: 1136) |
| ABE71251 | 28 | IVNANSNSSSQFQLIYNLTICELNGTDWLADKFD | 61 | (SEQ ID NO: 1137) |
| ABE71257 | 28 | LANASSNNSSHLQLIYNLTLCELNGTDWLANKFD | 61 | (SEQ ID NO: 1138) |
| ABE71258 | 28 | LVNANSNSSSHLQLIYNLTICELNGTDWLNNHFS | 61 | (SEQ ID NO: 1139) |
| ABE71260 | 30 | SFADGNGNNSTYQYIYNLTICELNGTKWLSGHFE | 63 | (SEQ ID NO: 1140) |
| ABE71261 | 28 | LANANSNSSSHLQLIYNLTLCELNGTDWLANKFD | 61 | (SEQ ID NO: 1141) |
| ABE71262 | 28 | LANASNHSSSHLQLIYNLTLCELNGTDWLANKFD | 61 | (SEQ ID NO: 1142) |
| ABE71264 | 28 | LANASNDSSSHLQLIYNLTLCELNGTDWLANKFD | 61 | (SEQ ID NO: 1143) |
| ABE71265 | 28 | PANASNDSSSHLQLIYNLTLCELNGTDWLANKFD | 61 | (SEQ ID NO: 1144) |
| ABE71266 | 28 | LVNADSNSSSHLQLIYNLTICELNGTDWLNNHFS | 61 | (SEQ ID NO: 1145) |
| ABE71267 | 29 | VNANSNSSSHLQLIYNLTICELNGTEWLGRKFD | 61 | (SEQ ID NO: 1146) |
| ABE71268 | 28 | LVNASSNSSSHLQLIYNLTICELNGTDWLNKHFG | 61 | (SEQ ID NO: 1147) |
| ABE71269 | 28 | LVNANSNSSSHLQLIYNLTICELNGTDWLDNHFS | 61 | (SEQ ID NO: 1148) |
| ABE71270 | 28 | LANASSNNSSHLQLIYNLTICELNGTDWLNNHFS | 61 | (SEQ ID NO: 1149) |
| ABE71274 | 28 | LVNAENNSSSHLQLIYNLTICELNGTDWLNKKFD | 61 | (SEQ ID NO: 1150) |
| ABE71277 | 28 | LVNAHSNSSSHLQLIYNLTICELNGTEWLNNRFS | 61 | (SEQ ID NO: 1151) |
| ABE71278 | 28 | LVNANSNSSSHFQLIYNLTLCELNGTDWLAQRFD | 61 | (SEQ ID NO: 1152) |
| ABE71287 | 28 | LVNASNNHSSHFQLIYNLTLCELNGTDWLANKFD | 61 | (SEQ ID NO: 1153) |
| ABE71293 | 28 | LANASNNNSSHLQLIYNLTLCELNGTDWLANKFD | 61 | (SEQ ID NO: 1154) |
| ABE71294 | 28 | LANASNNNSSHLQLIYNLTLCELNGTDWLANKFD | 61 | (SEQ ID NO: 1155) |
| ABE71295 | 28 | LVNASNNGSSHLQLIYNLTICELNGTDWLNDKFD | 61 | (SEQ ID NO: 1156) |
| ABE71296 | 28 | LVNASSNSSSHLQLIYNLTICELNGTDWLNDHFS | 61 | (SEQ ID NO: 1157) |
| ABE71298 | 28 | LANASNDSSSHLQLIYNLTLCELNGTDWLANKFD | 61 | (SEQ ID NO: 1158) |
| ABE71299 | 28 | LVNANSNSSSHLQLIYNLTICELNGTDWLNNHFS | 61 | (SEQ ID NO: 1159) |
| ABE71300 | 28 | LVNANNDSSSHLQLIYNLTICELNGTEWLNEHFS | 61 | (SEQ ID NO: 1160) |
| ABE71301 | 28 | LVNASSNSSSHLQLIYNLTLCELNGTDWLKDKFD | 61 | (SEQ ID NO: 1161) |
| ABE71302 | 28 | LVNADNNSSSHLQLIYNLTICELNGTDWLTTNFD | 61 | (SEQ ID NO: 1162) |

FIG. 3 (con't)

| | | | | |
|---|---|---|---|---|
| ABE71304 | 28 | LANASNNSSSHLQLIYNLTLCELNGTDWLANKFD | 61 | (SEQ ID NO: 1163) |
| ABE71305 | 28 | LVNANSNSSSHLQLIYNLTICELNGTEWLSNHFS | 61 | (SEQ ID NO: 1164) |
| ABE71307 | 28 | LVNANSNSSSHFQLIYNLTLCELNGTHWLANKFD | 61 | (SEQ ID NO: 1165) |
| ABE71313 | 28 | LVNASSNSSSHLQLIYNLTICELNGTDWLNNHFS | 61 | (SEQ ID NO: 1166) |
| ABE71314 | 28 | LANASNNSSSHLQLIYNLTLCELNGTDWLANKFD | 61 | (SEQ ID NO: 1167) |
| ABE71315 | 28 | LANASNDSSSHLQLIYNLTLCELNGTDWLANKFD | 61 | (SEQ ID NO: 1168) |
| ABE71316 | 28 | LANASXNSSSHLQLIYNLTLCELNGTDWLABKFD | 61 | (SEQ ID NO: 1169) |
| ABE71317 | 28 | LANASANSSSHLQLIYNLTLCELNGTDWLANKFD | 61 | (SEQ ID NO: 1170) |
| ABE71319 | 28 | LVNAHSNSSSHLQLIYNLTICELNGTEWLDEHFS | 61 | (SEQ ID NO: 1171) |
| ABE71322 | 28 | LVNANSSSSSHFQLIYNLTLCELNGTDWLADKFD | 61 | (SEQ ID NO: 1172) |
| ABE71325 | 28 | IVNANSNSSSQFQLIYNLTICELNGTDWLADKFD | 61 | (SEQ ID NO: 1173) |
| ABE71327 | 28 | LVNANSSSSSHLQLIYNLTLCELNGTDWLKDKFD | 61 | (SEQ ID NO: 1174) |
| ABE71330 | 28 | LVNASGNSSSHVQLIYNLTICELNGTDWLNNKFD | 61 | (SEQ ID NO: 1175) |
| ABE71335 | 28 | LVNAEENHSSHLQLIYNLTLCELNGTDWLKNKFD | 61 | (SEQ ID NO: 1176) |
| ABE71337 | 28 | LVNAGNNNSSHLQLIYNLTICELNGTDWLNKHFG | 61 | (SEQ ID NO: 1177) |
| ABE71338 | 28 | LVNASSNSSSHLQLIYNLTICELNGTDWLNNHFS | 61 | (SEQ ID NO: 1178) |
| ABE71342 | 28 | IVNANSNSSSHFQLIYNLTICELNGTDWLNHKFD | 61 | (SEQ ID NO: 1179) |
| ABE71343 | 28 | IVNANSNSSSQFQLIYNLTICELNGTDWLADKFD | 61 | (SEQ ID NO: 1180) |
| ABE71344 | 28 | LVNASGNSSSHLQLIYNLTICELNGTDWLNNHFS | 61 | (SEQ ID NO: 1181) |
| ABE71350 | 28 | LGNADSNSSSHLQLIYNLTICELNGTDWLNNHFS | 61 | (SEQ ID NO: 1182) |
| ABE71353 | 28 | LVNAGNSSSSHLQLIYNLTLCELNGTDWLGNKFD | 61 | (SEQ ID NO: 1183) |
| ABE71354 | 28 | LVNASNSSSSHLQLIYNLTICELNGTDWLNKSFD | 61 | (SEQ ID NO: 1184) |
| ABE71356 | 28 | LVNASSNSSSHLQLIYNLTLCELNGTDWLKDKFD | 61 | (SEQ ID NO: 1185) |
| ABE71362 | 28 | LVNADSNSSSHLQSIYNLTICELNGTDWLNNHFS | 61 | (SEQ ID NO: 1186) |
| ABE71363 | 28 | LVNASYSSSSHLQLIYNLTLCELNGTDWLANKFD | 61 | (SEQ ID NO: 1187) |
| ABE71365 | 28 | LVNANSNSSSHLQLIYNLTICELNGTDWLKNKFD | 61 | (SEQ ID NO: 1188) |
| ABE71367 | 28 | LANASGNSSSHLQLIYNLTLCELNGTDWLRNKFD | 61 | (SEQ ID NO: 1189) |
| ABE71368 | 28 | LVNADSNSSSHLQLIYNLTICELNGTDWLNEHFS | 61 | (SEQ ID NO: 1190) |
| ABE71370 | 28 | LVNASSNSSSHLQLIYNLTICELNGTDWLNNHFS | 61 | (SEQ ID NO: 1191) |
| ABE71371 | 28 | LVNAHSNSSSHLQLIYNLTICELNGTEWLNNRFS | 61 | (SEQ ID NO: 1192) |
| ABE71374 | 28 | LVNASNNSSSHLQLIYNLTICELNGTEWLNDHFS | 61 | (SEQ ID NO: 1193) |
| ABE71376 | 28 | IVNASNNSSSHLQLIYNLTICELNGTEWLNNHFS | 61 | (SEQ ID NO: 1194) |
| ABE71377 | 28 | LVNASSNSSSHLQLIYNLTICELNGTDWLDNHFS | 61 | (SEQ ID NO: 1195) |
| ABE71378 | 28 | LVNASSNSSSHLQLIYNLTICELNGTDWLNNHFS | 61 | (SEQ ID NO: 1196) |
| ABE71381 | 28 | LVNANSNSSSHFQLIYNLTLCELNGTDWLANKFD | 61 | (SEQ ID NO: 1197) |
| ABE71382 | 28 | LANASDNSSSHLQLIYNLTLCELNGTDWLANKFD | 61 | (SEQ ID NO: 1198) |
| ABE71390 | 28 | IVNANSNSSSQFQLIYNLTICELNGTDWLADKFD | 61 | (SEQ ID NO: 1199) |
| ABE71396 | 28 | IVNASSNSSSHFQLIYNLTLCELNGTDWLANHFD | 61 | (SEQ ID NO: 1200) |
| ABE71397 | 28 | LVNANSNSSSHFQLIYNLTLCELNGTDWLAGKFD | 61 | (SEQ ID NO: 1201) |
| ABE71403 | 28 | PVNADNSSSSYSQLIYNLTICELNGTDWLADKFN | 61 | (SEQ ID NO: 1202) |
| ABE71407 | 28 | LVNASSNSSSHLQLIYNLTICELNGTDWLNNHFS | 61 | (SEQ ID NO: 1203) |
| ABE71408 | 28 | IVNASNDSSSHLQLIYNLTICELNGTEWLNNHFS | 61 | (SEQ ID NO: 1204) |
| ABE71415 | 28 | LVNADGNSSSHFQLIYNLTICELNGTDWLNNHFS | 61 | (SEQ ID NO: 1205) |
| ABE71418 | 28 | LANASNNSSSHLQLIYNLTLCELNGTDWLANKFD | 61 | (SEQ ID NO: 1206) |
| ABE71421 | 28 | LVNANSNSSSHLQLIYNLTLCELNGTEWLAGRFD | 61 | (SEQ ID NO: 1207) |
| ABE71424 | 28 | LVNASGNSSSHFQLIYNLTICELNGTDWLNDHFS | 61 | (SEQ ID NO: 1208) |
| ABE71425 | 28 | LVNANGNSSSHLQLIYNLTICELNGTDWLNSHFS | 61 | (SEQ ID NO: 1209) |
| ABE71427 | 28 | LVNASSNSSSHFQLIYNLTICELNGTDWLNDHFS | 61 | (SEQ ID NO: 1210) |
| ABE71428 | 28 | LVNASNNSSSHLQLIYNLTICELNGTDWLNDRFD | 61 | (SEQ ID NO: 1211) |
| ABE71430 | 28 | LVNANSNSSSHLQLIYNLTICELNGTDWLNNHFS | 61 | (SEQ ID NO: 1212) |
| ABE71431 | 28 | LVNANSNSSSHLQLIYNLTLCELNGTDWLKNKFD | 61 | (SEQ ID NO: 1213) |
| ABE71434 | 28 | LVNASSNSSSHLQLIYNLTICELNGTDWLDKRFD | 61 | (SEQ ID NO: 1214) |
| ABE71438 | 28 | IVNANSSSSSHFQLIYNLTLCELNGTDWLASKFD | 61 | (SEQ ID NO: 1215) |
| ABE71439 | 28 | LVNAKSNSSSHLQLIYNLTLCELNGTBWLKDKFD | 61 | (SEQ ID NO: 1216) |
| ABE71440 | 28 | LANASNGSSSHLQLIYNLTLCELNGTDWLANKFD | 61 | (SEQ ID NO: 1217) |

FIG. 3 (con't)

| | | | | |
|---|---|---|---|---|
| ABE71441 | 28 | LVNASNNSSSHLQLIYNLTICELNGTDWLNGHFS | 61 | (SEQ ID NO: 1218) |
| ABE71451 | 28 | LVNASNNNSSHLQLIYNLTICELNGTDWLNXHFS | 61 | (SEQ ID NO: 1219) |
| ABE71454 | 28 | IVNANSNSSSQFQLIYNLTICELNGTDWLADKFD | 61 | (SEQ ID NO: 1220) |
| ABE71459 | 28 | LVNASNDSSSHLQLIYNLTICELNGTDWLNDKFD | 61 | (SEQ ID NO: 1221) |
| ABE71460 | 28 | LVNASSNSSSHLQLIYNLTICELNGTDWLNTHFS | 61 | (SEQ ID NO: 1222) |
| ABE71473 | 28 | LVNASSNSSSHLQLIYNLTICELNGTDWLNDHFS | 61 | (SEQ ID NO: 1223) |
| ABE71475 | 28 | LVNADSNSSSHLQLIYNLTICELNGTDWLNNHFS | 61 | (SEQ ID NO: 1224) |
| ABE71476 | 28 | IVNANSNSSSHFQLIYNLTICELNGTDWLNHKFD | 61 | (SEQ ID NO: 1225) |
| ABE71477 | 28 | LVNAKNNSSSHLQLIYNLTICELNGTDWLNKKFD | 61 | (SEQ ID NO: 1226) |
| ABE71478 | 28 | LVNANGNSSSHLQLIYNLTICELNGTDWLNNHFS | 61 | (SEQ ID NO: 1227) |
| ABE71479 | 28 | LVNANSNSSSHLQLIYNLTICELNGTDWLKNNFD | 61 | (SEQ ID NO: 1228) |
| ABE71481 | 28 | LVNASSNSSSHLQLIYNLTICELNGTDWLNNHFN | 61 | (SEQ ID NO: 1229) |
| ABE71482 | 28 | LVNADSNNSSHLQLIYNLTICELNGTDWLNNHFS | 61 | (SEQ ID NO: 1230) |
| ABE71484 | 28 | LVNANSNSSSHLQLIYNLTICELNGTDWLDRHFS | 61 | (SEQ ID NO: 1231) |
| ABE71487 | 28 | LVNASNNSSSHLQLIYNLTICELNGTDWLDKHFS | 61 | (SEQ ID NO: 1232) |
| ABE71490 | 28 | IVNASSNSSSQFQLIYNLTICELNGTEWLANKFD | 61 | (SEQ ID NO: 1233) |
| ABE71497 | 28 | LVNANSNSSSHLQLIYNLTLCELNGTEWLAGRFD | 61 | (SEQ ID NO: 1234) |
| ABE71500 | 28 | LVNANSNSSSHFQLIYNLTLCELNGTDWLADKFD | 61 | (SEQ ID NO: 1235) |
| ABE71503 | 28 | LVNASSNSSSHLQLIYNLTICELNGTDWLNGHFS | 61 | (SEQ ID NO: 1236) |
| ABE71512 | 28 | LVNAHSNSSSHLQLIYNLTICELNGTDWLNNHFS | 61 | (SEQ ID NO: 1237) |
| ABE71516 | 28 | LVNASNNSSSHLQLIYNLTICELNGTDWLNNHFS | 61 | (SEQ ID NO: 1238) |
| ABE71520 | 28 | LVNANSNSSSHFQLIYNLTLCELNGTDWLANKFD | 61 | (SEQ ID NO: 1239) |
| ABE71522 | 28 | LVNANSNSSSHFQLIYNLTLCELNGTEWLGNKFD | 61 | (SEQ ID NO: 1240) |
| ABE71524 | 28 | IVNASSNSSSHFQLIYNLTLCELNGTDWLAEKFD | 61 | (SEQ ID NO: 1241) |
| ABE71525 | 28 | LVNAHSNSSSHFQLIYNLTLCELNGTEWLGNKFD | 61 | (SEQ ID NO: 1242) |
| ABE71526 | 28 | LVNASNNDSSHLQSIYNLTICELNGTDWLSNKFD | 61 | (SEQ ID NO: 1243) |
| ABE71528 | 28 | LVNASNNSSSHFQLIYNLTICELNGTDWLNEHFS | 61 | (SEQ ID NO: 1244) |
| ABE71530 | 28 | LVNASGNSSSHLQLIYNLTICELNGTDWLNNTFD | 61 | (SEQ ID NO: 1245) |
| ABE71531 | 28 | LVNADSNSSSHLQLIYNLTICELNGTDWLNSHFS | 61 | (SEQ ID NO: 1246) |
| ABE71535 | 28 | LVNANSSSSSHFQLIYNLTLCELNGTDWLAEKFD | 61 | (SEQ ID NO: 1247) |
| ABE71541 | 28 | LVNASNNSSSHLQLIYNLTICELNGTDWLBKHFS | 61 | (SEQ ID NO: 1248) |
| ABE71542 | 28 | LVNANNNSSSHLQLIYNLTICELNGTDWLNSHFS | 61 | (SEQ ID NO: 1249) |
| ABE71545 | 28 | LVNASNNSSSHLQSIYNLTICELNGTDWLNGHFS | 61 | (SEQ ID NO: 1250) |
| ABE71549 | 28 | LVNANNSSSSHIQLIYNLTLCELNGTDWLANKFD | 61 | (SEQ ID NO: 1251) |
| ABE71552 | 28 | LVNASGNSSSHLQLIYNLTICELNGTDWLNDHFS | 61 | (SEQ ID NO: 1252) |
| ABE71553 | 28 | LVNASNNSSSHLQLIYNLTLCELNGTDWLANRFD | 61 | (SEQ ID NO: 1253) |
| ABE71554 | 28 | LVNANSNSSSHFQLIYNLTLCELNGTDWLKGKFD | 61 | (SEQ ID NO: 1254) |
| ABE71559 | 28 | LANAHSNSSSHLQLIYNLTICELNGTDWLDKHFS | 61 | (SEQ ID NO: 1255) |
| ABE71561 | 28 | LVNANRNNSSHLQLIYNLTLCELNGTDWLKNKFD | 61 | (SEQ ID NO: 1256) |
| ABE71568 | 28 | LVNANSSSSSHLQLIYNLTLCELNGTDWLNNKFD | 61 | (SEQ ID NO: 1257) |
| ABE71569 | 28 | LVNANSNSSSHFQLIYNLTICELNGTEWLSNHFS | 61 | (SEQ ID NO: 1258) |
| ABE71572 | 28 | LVNASNSSSSHLQLIYNLTLCELNGTDWLANKFD | 61 | (SEQ ID NO: 1259) |
| ABE71573 | 28 | LVNASSNSSSHLQLIYNLTICELNGTDWLDNRFS | 61 | (SEQ ID NO: 1260) |
| ABE71574 | 28 | LVNASNNSSSHLQLIYNLTICELNGTDWLNXHFS | 61 | (SEQ ID NO: 1261) |
| ABE71577 | 28 | LVNASSNSSSHLQLIYNLTICELNGTDWLNNHFS | 61 | (SEQ ID NO: 1262) |
| ABE71579 | 28 | LVNASGNSSSHFQLIYNLTICELNGTDWLNDHFS | 61 | (SEQ ID NO: 1263) |
| ABE71580 | 28 | IVNASSNSSSHLQLIYNLTICELNGTDWLNNHFS | 61 | (SEQ ID NO: 1264) |
| ABE71581 | 28 | LVNANSNSSSHLQSIYNLTICELNGTDWLNDHFS | 61 | (SEQ ID NO: 1265) |
| ABE71586 | 28 | LVNASSNSSSHLQLIYNLTICELNGTDWLKDHFS | 61 | (SEQ ID NO: 1266) |
| ABE71587 | 28 | LVNASGNSSSHFQLIYNLTICELNGTDWLNDHFS | 61 | (SEQ ID NO: 1267) |
| ABE71588 | 28 | LVNANSSSGSHLQLIYNLTLCELNGTDWLGNKFD | 61 | (SEQ ID NO: 1268) |
| ABE71592 | 28 | LVNANSSNSSHLQLIYNLTICELNGTDWLDNHFS | 61 | (SEQ ID NO: 1269) |
| ABE71600 | 28 | LVNASNNNSSHLQLIYNLTICELNGTDWLDGHFS | 61 | (SEQ ID NO: 1270) |
| ABE71601 | 28 | LVNASSNSSSHLQLIYNLTICELNGTDWLNSHFS | 61 | (SEQ ID NO: 1271) |
| ABE71602 | 28 | LVNASSNSSSHLQLIYNLTICELNGTDWLNNHFS | 61 | (SEQ ID NO: 1272) |

FIG. 3 (con't)

| | | | | |
|---|---|---|---|---|
| ABE71603 | 28 | LVNASNSSSSHLQLIYNLTICELNGTDWLDSHFS | 61 | (SEQ ID NO: 1273) |
| ABE71604 | 28 | LVNANSNSSSHFQLIYNLTLCELNGTEWLSNRFD | 61 | (SEQ ID NO: 1274) |
| ABE71606 | 28 | LVNANSNSSSHLQLIYNLTLCELNGTDWLKDKFD | 61 | (SEQ ID NO: 1275) |
| ABE71611 | 28 | LVNASSNSSSHLQLIYNLTICELNGTDWLNNHFS | 61 | (SEQ ID NO: 1276) |
| ABE71612 | 28 | LVNADSNNSSHLQSIYNLTICELNGTDWLNNKFD | 61 | (SEQ ID NO: 1277) |
| ABE71614 | 28 | LVNASNNSSSHLQLIYNLTICELNGTDWLNKSFD | 61 | (SEQ ID NO: 1278) |
| ABE71617 | 28 | LVNANSNSSSHLQSIYNLTICELNGTDWLNDHFS | 61 | (SEQ ID NO: 1279) |
| ABE71621 | 28 | LVNASSNNSSHLQLIYNLTICELNGTDWLDNHFS | 61 | (SEQ ID NO: 1280) |
| ABE71624 | 28 | LANASENSSSHLQLIYNLTLCELNGTDWLKNKFD | 61 | (SEQ ID NO: 1281) |
| ABE71625 | 28 | LVNANSNSSSHLQLIYNLTICELNGTDWLNNHFS | 61 | (SEQ ID NO: 1282) |
| ABE71626 | 28 | LVNATSNSSSHLQLIYNLTLCELNGTDWLKDKFD | 61 | (SEQ ID NO: 1283) |
| ABE71629 | 28 | LANAHSGNSSHLQLIYNLTICELNGTDWLNNHFS | 61 | (SEQ ID NO: 1284) |
| ABE71630 | 28 | LVNASSNSSSHLQLIYNLTLCELNGTDWLKDKFD | 61 | (SEQ ID NO: 1285) |
| ABE71631 | 29 | LVNANNNSSSHLQLIYNLTICELNGTDWLNKSFD | 61 | (SEQ ID NO: 1286) |
| ABE71639 | 28 | IVNANSNSSSQFQLIYNLTICELNGTDWLANKFD | 61 | (SEQ ID NO: 1287) |
| ABE71642 | 28 | LVNASSNNSSHLQLIYNLTICELNGTDWLDRHFG | 61 | (SEQ ID NO: 1288) |
| ABE71644 | 28 | LVNANSNSSSHLQSIYNLTICELNGTDWLNNHFS | 61 | (SEQ ID NO: 1289) |
| ABE71649 | 28 | LVNANSNSSSHLQLIYNLTICELNGTDWLNNHFS | 61 | (SEQ ID NO: 1290) |
| ABE71650 | 28 | LVNASNSSSSHLQLIYNLTICELNGTDWLNNHFS | 61 | (SEQ ID NO: 1291) |
| ABE71653 | 28 | LVNADSNSSSHLQLIYNLTICELNGTEWLNEHFS | 61 | (SEQ ID NO: 1292) |
| ABE71657 | 28 | LVNANNDSSSHLQLIYNLTICELNGTDWLNKHFS | 61 | (SEQ ID NO: 1293) |
| ABE71659 | 28 | LANASNNSSSHLQLIYNLTLCELNGTDWLADKFD | 61 | (SEQ ID NO: 1294) |
| ABE71660 | 28 | LVNASSNSSSHLQLIYNLTICELNGTDWLNEHFS | 61 | (SEQ ID NO: 1295) |
| ABE71661 | 28 | LVNANSNSSSHLQXIYNLTICELNGTDWLNNHFS | 61 | (SEQ ID NO: 1296) |
| ABE71663 | 28 | LVNAGNNNSSHLQLIYNLTICELNGTDWLNRHFS | 61 | (SEQ ID NO: 1297) |
| ABE71664 | 28 | LVNASNGSSSNLQLIYNLTICELNGTDWLNDHFS | 61 | (SEQ ID NO: 1298) |
| ABE71665 | 28 | LVNAGGNSSSHFQLIYNLTICELNGTDWLNDHFS | 61 | (SEQ ID NO: 1299) |
| ABE71666 | 28 | LVNAGGNSSSHFQLIYNLTICELNGTDWLNDHFS | 61 | (SEQ ID NO: 1300) |
| ABE71670 | 28 | LVNANSNNSSHLQLIYNLTICELNGTDWLNEHFS | 61 | (SEQ ID NO: 1301) |
| ABE71676 | 28 | LVNANNYSSSHLQLIYNLTICELNGTDWLNNHFS | 61 | (SEQ ID NO: 1302) |
| ABE71685 | 28 | LVNANRNSSSHLQLIYNLTLCELNGTDWLKDKFD | 61 | (SEQ ID NO: 1303) |
| ABE71689 | 28 | LVNASGNSSSHLQLIYNLTICELNGTEWLGNHFS | 61 | (SEQ ID NO: 1304) |
| ABE71690 | 28 | LVNASTNSSSHLQLIYNLTICELNGTEWLNNHFS | 61 | (SEQ ID NO: 1305) |
| ABE71696 | 28 | LVNADSNSSSHLQLIYNLTICELNGTEWLNNHFS | 61 | (SEQ ID NO: 1306) |
| ABE71705 | 28 | LANAHSNSSSHLQLIYNLTICELNGTDWLDKHFS | 61 | (SEQ ID NO: 1307) |
| ABE71706 | 28 | LVNANSNSSSHLQLIYNLTICELNGTHWLYEHFS | 61 | (SEQ ID NO: 1308) |
| ABE71709 | 28 | LVNAGSNSSSHLQLIYNLTICELNGTXWLNNHFS | 61 | (SEQ ID NO: 1309) |
| ABE71710 | 28 | LVNADSNNSSHLQLIYNLTICELNGTDWLDEHFS | 61 | (SEQ ID NO: 1310) |
| ABE71717 | 28 | IVNASSNSSSHIQLIYNLTICELNGTDWLNHKFD | 61 | (SEQ ID NO: 1311) |
| ABE71732 | 28 | LVNANSNSSSHLQLIYNLTICELNGTDWLYEHFS | 61 | (SEQ ID NO: 1312) |
| ABE71734 | 28 | PANANNGSSSHLQLIYNLTLCELNGTDWLADKFD | 61 | (SEQ ID NO: 1313) |
| ABE71743 | 28 | LANASNNSSSHLQLIYNLTLCELNGTDWLASKFD | 61 | (SEQ ID NO: 1314) |
| ABE71751 | 28 | LVNADSNSSSHFQLIYNLTLCELNGTDWLAKNFD | 61 | (SEQ ID NO: 1315) |
| ABE71755 | 28 | LANASDNSSSHLQLIYNLTLCELNGTDWLADKFD | 61 | (SEQ ID NO: 1316) |
| ABE71756 | 28 | LANANSNSSSHLQLIYNLTLCELNGTDWLANKFD | 61 | (SEQ ID NO: 1317) |
| ABE71759 | 28 | FANASGNSSSHLQLIYNLTLCELNGTDWLANKFD | 61 | (SEQ ID NO: 1318) |
| ABE71761 | 28 | LANASNDSSSHLQLIYNLTLCELNGTDWLANKFD | 61 | (SEQ ID NO: 1319) |
| ABE71762 | 28 | LVNANSNSSSHFQLIYNLTLCELNGTDWLANKFD | 61 | (SEQ ID NO: 1320) |
| ABE71763 | 28 | LVNANSNSSXHFQLIYNLTLCELNGTDWLANKFD | 61 | (SEQ ID NO: 1321) |
| ABE71764 | 28 | LANASDNSSSHLQLIYNLTLCELNGTDWLANRFD | 61 | (SEQ ID NO: 1322) |
| ABE71769 | 28 | LANASANSSSHLQLIYNLTLCELNGTDWLANKFD | 61 | (SEQ ID NO: 1323) |
| ABE71771 | 28 | LVNASSNSSSHLQLIYNLTLCELNGTDWLANKFD | 61 | (SEQ ID NO: 1324) |
| ABE71773 | 28 | LANASSDSSSHLQLIYNLTLCELNGTDWLANKFD | 61 | (SEQ ID NO: 1325) |
| ABE71775 | 28 | LANASNDSSSHLQLIYNLTLCELNGTDWLANKFD | 61 | (SEQ ID NO: 1326) |
| ABE71776 | 28 | LVNASNNSSSHLQLIYNLTLCELNGTDWLADKFD | 61 | (SEQ ID NO: 1327) |

FIG. 3 (con't)

| | | | | |
|---|---|---|---|---|
| ABE71777 | 28 | LVNANSNSSSHFQLIYNLTLCELNGTDWLANNFN | 61 | (SEQ ID NO: 1328) |
| ABE71778 | 28 | LANANSNSSSHLQLIYNLTLCELNGTDWLADKFD | 61 | (SEQ ID NO: 1329) |
| ABE71783 | 28 | LVNATSNSSSHFQLIYNLTLCELNGTDWLAGKFN | 61 | (SEQ ID NO: 1330) |
| ABE71801 | 28 | LANANNDSSSHLQLIYNLTLCELNGTDWLANKFD | 61 | (SEQ ID NO: 1331) |
| ABE71802 | 28 | LVNASNNSSSHLQLIYNLTLCELNGTDWLADKFD | 61 | (SEQ ID NO: 1332) |
| ABE71805 | 28 | LANASDNSSSHLQLIYNLTLCELNGTDWLADKFD | 61 | (SEQ ID NO: 1333) |
| ABE71809 | 28 | LANADSNSSSHFQLIYNLTLCELNGTDWLNKKFD | 61 | (SEQ ID NO: 1334) |
| ABE71811 | 28 | LVNANSTSSSHFQLIYNLTLCELNGTDWLADKFD | 61 | (SEQ ID NO: 1335) |
| ABE71815 | 28 | LVNANSNSSSHLQLIYNLTLCELNGTDWLGKQFD | 61 | (SEQ ID NO: 1336) |
| ABE71816 | 28 | LANASNNSSSHLQLIYNLTLCELNGTDWLANQFD | 61 | (SEQ ID NO: 1337) |
| ABE71817 | 28 | LANASNNNSSHLQLIYNLTLCELNGTDWLANKFD | 61 | (SEQ ID NO: 1338) |
| ABE71819 | 28 | LVNANSSSSSHFQLIYNLTICELNGTDWLDNKFD | 61 | (SEQ ID NO: 1339) |
| ABE71831 | 28 | LVNANSNSSSHFQLIYNLTLCELNGTDWLANKFD | 61 | (SEQ ID NO: 1340) |
| ABE71847 | 28 | LANASNNSSSHLQLIYNLTLCELNGTDWLANKFD | 61 | (SEQ ID NO: 1341) |
| ABE71851 | 28 | LANASNNSSSHLQLIYNLTLCELNGTDWLASKFD | 61 | (SEQ ID NO: 1342) |
| ABE71870 | 28 | IVNASSNSSSHFQLIYNLTLCELNGTDWLANKFD | 61 | (SEQ ID NO: 1343) |
| ABE71871 | 28 | IVNASSNSSSHFQLIYNLTLCELNGTDWLANKFD | 61 | (SEQ ID NO: 1344) |
| ABE71872 | 28 | IVNAGSNSSSHFQLIYNLTLCELNGTDWLANKFD | 61 | (SEQ ID NO: 1345) |
| ABE71875 | 28 | LANASNNSSSHLQLIYNLTLCELNGTDWLANKFD | 61 | (SEQ ID NO: 1346) |
| ABE71876 | 28 | LVNASNDNSSHLQLIYNLTLCELNGTDWLANKFD | 61 | (SEQ ID NO: 1347) |
| ABE71878 | 28 | LANASGNSSSHLQLIYNLTLCELNGTDWLANRFD | 61 | (SEQ ID NO: 1348) |
| ABE71890 | 28 | LVNANSSSSSHFQLIYNLTLCELNGTDWLAEKFD | 61 | (SEQ ID NO: 1349) |
| ABE71891 | 28 | PANANSNSSSHLQLIYNLTLCELNGTDWLANKFD | 61 | (SEQ ID NO: 1350) |
| ABE71892 | 28 | PANANSNSSSHLQLIYNLTLCELNGTDWLANKFD | 61 | (SEQ ID NO: 1351) |
| ABE71893 | 28 | LVNANSNSSSHFQLIYNLTLCELNGTDWLANKFD | 61 | (SEQ ID NO: 1352) |
| ABE71897 | 28 | LVNANSNSSSHFQLIYNLTLCELNGTDWLDKKFD | 61 | (SEQ ID NO: 1353) |
| ABE71900 | 28 | LANASNNSSSHLQLIYNLTLCELNGTDWLANKFD | 61 | (SEQ ID NO: 1354) |
| ABE71905 | 28 | LVNANGNSSSHLQLIYNLTLCELNGTDWLANKFD | 61 | (SEQ ID NO: 1355) |
| ABE71909 | 28 | IVNASSNSSSHFQLIYNLTLCELNGTEWLANKFD | 61 | (SEQ ID NO: 1356) |
| ABE71913 | 28 | LVNANSSSSSHFQLIYNLTLCELNGTDWLAEKFD | 61 | (SEQ ID NO: 1357) |
| ABE71914 | 28 | LVNANSSSSSHFQLIYNLTLCELNGTDWLAEKFD | 61 | (SEQ ID NO: 1358) |
| ABE71916 | 28 | LVNANSSSSSHFQLIYNLTLCELNGTDWLAEKFD | 61 | (SEQ ID NO: 1359) |
| ABE71929 | 28 | LVNAXSSSSSHFQLIYNLTLCELNGTDWLAEKFD | 61 | (SEQ ID NO: 1360) |
| ABE71933 | 28 | LANASNDSSSHLQLIYNLTLCELNGTDWLANKFD | 61 | (SEQ ID NO: 1361) |
| ABE71936 | 28 | LVNASNNSSSHFQLIYNLTLCELNGTDWLAGKFD | 61 | (SEQ ID NO: 1362) |
| ABE71937 | 28 | LANASNDSSSHLQLIYNLTLCELNGTDWLANKFD | 61 | (SEQ ID NO: 1363) |
| ABE71941 | 28 | LANASNDSSSHLQLIYNLTLCELNGTDWLANKFD | 61 | (SEQ ID NO: 1364) |
| ABE71943 | 28 | LVNANSNNSSHLQLIYNLTLCSLNGTDWLANKFD | 61 | (SEQ ID NO: 1365) |
| ABE71945 | 28 | IVNASSNSSSHFQLIYNLTLCELNGTDWLANKFD | 61 | (SEQ ID NO: 1366) |
| ABE71947 | 28 | LVNANSSSSSHFQLIYNLTLCELNGTDWLGNKFD | 61 | (SEQ ID NO: 1367) |
| ABE71951 | 28 | LANASNDSSSHLQLIYNLTLCELNGTDWLANKFD | 61 | (SEQ ID NO: 1368) |
| ABE71956 | 28 | LVNADSTSSSHFQLIYNLTLCELNGTDWLSDKFD | 61 | (SEQ ID NO: 1369) |
| ABE71958 | 28 | LVNANSNSSSHFQLIYNLTLCELNGTDWLNKKFD | 61 | (SEQ ID NO: 1370) |
| ABE71964 | 28 | LANASNDSSSHLQLIYNLTLCELNGTDWLANKFD | 61 | (SEQ ID NO: 1371) |
| ABE71965 | 28 | LVNASNNSSSHLQLIYNLTLCELNGTDWLANKFD | 61 | (SEQ ID NO: 1372) |
| ABE71968 | 28 | LANASNDSSSHLQLIYNLTLCELNGTDWLANKFD | 61 | (SEQ ID NO: 1373) |
| ABE71972 | 28 | LVNASSNSSSHLQLIYNLTICELNGTDWLNHKFD | 61 | (SEQ ID NO: 1374) |
| ABE71974 | 28 | IVNASSNSSSHFQLIYNLTLCELNGTEWLADKFD | 61 | (SEQ ID NO: 1375) |
| ABE71976 | 28 | IVNASSNSSSHFQLIYNLTLCELNGTDWLANKFN | 61 | (SEQ ID NO: 1376) |
| ABE71979 | 28 | LVNASSNSSSHFQLIYNLTLCELNGTDWLAGKFD | 61 | (SEQ ID NO: 1377) |
| ABE71982 | 28 | LVNASDNSSSHLQLIYNLTLCELNGTDWLANKFD | 61 | (SEQ ID NO: 1378) |
| ABE71984 | 28 | LVDANSNSSSHFQLIYNLTLCELNGTDWLKDHFN | 61 | (SEQ ID NO: 1379) |
| ABE71991 | 28 | LVNANSNSSSHFQLIYNLTLCELNGTDWLNKKFD | 61 | (SEQ ID NO: 1380) |
| ABE72002 | 28 | LVNANSNSSSHFQLIYNLTLCELNGTDWLNNKFD | 61 | (SEQ ID NO: 1381) |
| ABE72007 | 28 | LVNANSNSSSHFQLIYNLTLCELNGTDWLAENFD | 61 | (SEQ ID NO: 1382) |

FIG. 3 (con't)

| | | | | |
|---|---|---|---|---|
| ABE72016 | 28 | LVDANSNSSSHLQLIYNLTLCELNGTDWLKDHFN | 61 | (SEQ ID NO: 1383) |
| ABE72024 | 28 | LANASNNSSSHLQLIYNLTLCELNGTDWLANKFD | 61 | (SEQ ID NO: 1384) |
| ABE72028 | 28 | LANASDNSSSHLQLIYNLTLCELNGTDWLADKFD | 61 | (SEQ ID NO: 1385) |
| ABE72041 | 28 | LANASADSSSHLQLIYNLTLCELNGTDWLANKFD | 61 | (SEQ ID NO: 1386) |
| ABE72043 | 28 | LVNANSNSSSHFQLIYNLTLCELNGTDWLADKFD | 61 | (SEQ ID NO: 1387) |
| ABE72044 | 28 | LVNANSNSSSHFQLIYNLTLCELNGTDWLADKFD | 61 | (SEQ ID NO: 1388) |
| ABE72050 | 28 | LVNANSNSSSHFQLIYNLTLCELNGTDWLAKSFD | 61 | (SEQ ID NO: 1389) |
| ABE72055 | 28 | LANASNDSSSHLQLIYNLTLCELNGTDWLANKFD | 61 | (SEQ ID NO: 1390) |
| ABE72067 | 28 | LVNANSNSSSHFQLIYNLTLCELNGTEWLAEKFD | 61 | (SEQ ID NO: 1391) |
| ABE72071 | 28 | LVNAHSNSSSQFQLIYNLTLCELNGTDWLANKFD | 61 | (SEQ ID NO: 1392) |
| ABE72072 | 28 | LVNANSNSSSHFQLIYNLTLCELNGTDWLAKSFD | 61 | (SEQ ID NO: 1393) |
| ABE72073 | 28 | LVNANSNSSSHFQLIYNLTLCELNGTDWLAEKFD | 61 | (SEQ ID NO: 1394) |
| ABE72078 | 28 | LANASNNSSSHLQLIYNLTLCELNGTDWLADKFD | 61 | (SEQ ID NO: 1395) |
| ABE72085 | 28 | LVNANSNSSSHFQLIYNLTLCELNGTDWLAEKFD | 61 | (SEQ ID NO: 1396) |
| ABE72087 | 28 | LVNANSSSSSHFQLIYNLTLCELNGTDWLSNKFD | 61 | (SEQ ID NO: 1397) |
| ABE72097 | 28 | LVNANSNSSSHFQLIYNLTLCELNGTDWLNEKFD | 61 | (SEQ ID NO: 1398) |
| ABE72099 | 28 | IVNASSNSSSHFQLIYNLTLCELNGTEWLADKFD | 61 | (SEQ ID NO: 1399) |
| ABE72100 | 28 | LVSANSNSSSHLQLIYNLTLCELNGTDWLANKFD | 61 | (SEQ ID NO: 1400) |
| ABE72101 | 28 | LVNANSTSSSHFQLIYNLTLCELNGTDWLAGKFD | 61 | (SEQ ID NO: 1401) |
| ABE72111 | 28 | LVNASNNSSSHFQLIYNLTLCELNGTDWLAGKFD | 61 | (SEQ ID NO: 1402) |
| ABE72112 | 28 | LVNANSNSSSHLQLIYNLTLCELNGTDWLANKFD | 61 | (SEQ ID NO: 1403) |
| ABE72120 | 28 | LVDANSNSSSHFQLIYNLTLCELNGTDWLKNHFN | 61 | (SEQ ID NO: 1404) |
| ABE72122 | 28 | LANASNDSSSHLQLIYNLTLCELNGTDWLANKFD | 61 | (SEQ ID NO: 1405) |
| ABE72134 | 28 | IVNANSNSSSHFQLIYNLTICELNGTDWLNGKFD | 61 | (SEQ ID NO: 1406) |
| ABE72141 | 28 | LANASDNSSSHLQLIYNLTLCELNGTDWLANKFD | 61 | (SEQ ID NO: 1407) |
| ABE72142 | 28 | LVNANSNSSSHFQLIYNLTLCELNGTDWLNNKFD | 61 | (SEQ ID NO: 1408) |
| ABE72149 | 28 | LVNASSNSSSHFQLIYNLTLCELNGTEWLSNKFD | 61 | (SEQ ID NO: 1409) |
| ABE72155 | 28 | LANASDNSSSHLQLIYNLTLCELNGTDWLANKFD | 61 | (SEQ ID NO: 1410) |
| ABE72156 | 28 | IVNASSNSSSHFQLIYNLTLCELNGTEWLADKFD | 61 | (SEQ ID NO: 1411) |
| ABE72158 | 28 | IVNANSNSSSHLQLIYNLTLCELNGTDWLGSRFD | 61 | (SEQ ID NO: 1412) |
| ABE72161 | 28 | IVNASSNNSSHFQXIYNLTLCELNGTDWLANKFD | 61 | (SEQ ID NO: 1413) |
| ABE72162 | 28 | IVNASSNNSSHFQSIYNLTLCELNGTDWLANKFD | 61 | (SEQ ID NO: 1414) |
| ABE72164 | 28 | IVNASSNSSSHFQLIYNLTLCELNGTEWLVNKFD | 61 | (SEQ ID NO: 1415) |
| ABE72166 | 28 | LVNANSASSSHFQLIYNLTLCELNGTDWLAGKFD | 61 | (SEQ ID NO: 1416) |
| ABE72168 | 28 | LVNASTNSSSHFQLIYNLTLCELNGTDWLAEKFD | 61 | (SEQ ID NO: 1417) |
| ABE72169 | 28 | IVNANSNSSSHFQLIYNLTICELNGTDWLNEKFD | 61 | (SEQ ID NO: 1418) |
| ABE72173 | 28 | IVNANSNSSSHFQLIYNLTLCELNGTDWLADKFD | 61 | (SEQ ID NO: 1419) |
| ABE72175 | 28 | LVNANSNNSSHFQLIYNLTLCELNGTDWLANKFD | 61 | (SEQ ID NO: 1420) |
| ABE72177 | 28 | LANASNDSSSHLQLIYNLTLCELNGTDWLANKFD | 61 | (SEQ ID NO: 1421) |
| ABE72178 | 28 | LVNANSTSSSHFQLIYNLTLCELNGTEWLANRFD | 61 | (SEQ ID NO: 1422) |
| ABE72179 | 28 | LVNANSNSSSHFQLIYNLTLCELNGTEWLADRFD | 61 | (SEQ ID NO: 1423) |
| ABE72180 | 28 | LVNANSTSSSHFQLIYNLTLCELNGTEWLANRFD | 61 | (SEQ ID NO: 1424) |
| ABE72182 | 28 | LANASNNSSSHLQLIYNLTLCELNGTDWLANKFD | 61 | (SEQ ID NO: 1425) |
| ABE72184 | 28 | IVNANSNSSSHFQLIYNLTLCELNGTEWLADKFD | 61 | (SEQ ID NO: 1426) |
| ABE72185 | 28 | LANASNHSSSHLQLIYNLTLCELNGTDWLANKFD | 61 | (SEQ ID NO: 1427) |
| ABE72187 | 28 | PVNANGNSSSKLQLIYNLTLCELNGTDWLANRFD | 61 | (SEQ ID NO: 1428) |
| ABE72188 | 28 | LVNANSSSSSHFQLIYNLTLCELNGTDWLRNKFD | 61 | (SEQ ID NO: 1429) |
| ABE72191 | 28 | LVNANSNSSSHFQLIYNLTLCELNGTDWLNGKFD | 61 | (SEQ ID NO: 1430) |
| ABE72193 | 28 | LVNANSNSSSHFQLIYNLTLCELNGTDWLANKFE | 61 | (SEQ ID NO: 1431) |
| ABE72195 | 28 | IANASNBSSSHLQLIYNLTLCELNGTDWLANKFD | 61 | (SEQ ID NO: 1432) |
| ABE72196 | 28 | IVNANSNSSSHFQLIYNLTICELNGTDWLNNNFD | 61 | (SEQ ID NO: 1433) |
| ABE72199 | 28 | LVNASSNSSSHFQLIYNLTLCELNGTDWLAEKFD | 61 | (SEQ ID NO: 1434) |
| ABE72201 | 28 | LANASNNSSSHLQLIYNLTLCELNGTDWLANKFD | 61 | (SEQ ID NO: 1435) |
| ABE72202 | 28 | LVNANSNSSSHFQLIYNLTLCELNGTDWLAGKFD | 61 | (SEQ ID NO: 1436) |
| ABE72204 | 28 | LVNASNSSSSHLQLIYNLTICELNGTDWLNNKFD | 61 | (SEQ ID NO: 1437) |

FIG. 3 (con't)

| | | | | |
|---|---|---|---|---|
| ABE72205 | 28 | LVNANNSSSSHLQLIYNLTLCELNGTEWLANKFD | 61 | (SEQ ID NO: 1438) |
| ABE72212 | 28 | LVNASTNSSSHFQLIYNLTLCELNGTDWLAKKFD | 61 | (SEQ ID NO: 1439) |
| ABE72214 | 28 | LVNANSNSSSHFQLIYNLTLCELNGTDWLAKNFD | 61 | (SEQ ID NO: 1440) |
| ABE72215 | 28 | LVNANSNSSSHLQLIYNLTLCELNGTDWLSNKFD | 61 | (SEQ ID NO: 1441) |
| ABE72216 | 28 | LVNANSNSSSHLQLIYNLTLCELNGTDWLSNKFD | 61 | (SEQ ID NO: 1442) |
| ABE72217 | 28 | LVNANSNSSSHLQLIYNLTLCELNGTDWLSNKFD | 61 | (SEQ ID NO: 1443) |
| ABE72218 | 28 | LVNANSNSSSHLQLIYNLTLCELNGTDWLSNKFD | 61 | (SEQ ID NO: 1444) |
| ABE72221 | 28 | LVDANSNSSSHFQLIYNLTLCELNGTDWLKDHFN | 61 | (SEQ ID NO: 1445) |
| ABE72228 | 28 | LVNASNSSSSHLQLIYNLTLCELNGTDWLADKFD | 61 | (SEQ ID NO: 1446) |
| ABE72230 | 28 | IVNASSNSSSHFQLIYNLTLCELNGTDWLANKFN | 61 | (SEQ ID NO: 1447) |
| ABE72231 | 28 | LANASNNSSSHLQLIYNLTLCELNGTDWLANKFD | 61 | (SEQ ID NO: 1448) |
| ABE72232 | 28 | LANASNNSSSHLQLIYNLTLCELNGTDWLANKFD | 61 | (SEQ ID NO: 1449) |
| ABE72237 | 28 | LVNASSNSSSHFQLIYNLTLCELNGTDWLAGKFD | 61 | (SEQ ID NO: 1450) |
| ABE72241 | 28 | LVNASSNSSSHFQLIYNLTLCELNGTDWLNNKFD | 61 | (SEQ ID NO: 1451) |
| ABE72244 | 28 | LANASNDSSSHLQLIYNLTLCELNGTDWLANKFD | 61 | (SEQ ID NO: 1452) |
| ABE72252 | 28 | LVNANSSSSSHIQLIYNLTLCELNGTDWLTNKFD | 61 | (SEQ ID NO: 1453) |
| ABE72253 | 28 | LVNASNNSSSHLQLIYNLTICELNGTDWLDKHFS | 61 | (SEQ ID NO: 1454) |
| ABE72256 | 28 | LVNANSNSSSHLQLIYNLTICELNGTDWLKDKFE | 61 | (SEQ ID NO: 1455) |
| ABE72259 | 28 | LVNANSNSSSHLQLIYNLTLCELNGTDWLASKFD | 61 | (SEQ ID NO: 1456) |
| ABE72262 | 28 | LVNAGNSSSSHLQLIYNLTLCELNGTDWLANKFD | 61 | (SEQ ID NO: 1457) |
| ABE72263 | 28 | LANAHGNSSSHLQLIYNLTLCELNGTDWLADRFD | 61 | (SEQ ID NO: 1458) |
| ABE72266 | 28 | LVNANSNSSSHIQLIYNLTLCELNGTDWLAENFD | 61 | (SEQ ID NO: 1459) |
| ABE72270 | 28 | LANASNDSSSHLQLIYNLTLCELNGTDWLANKFD | 61 | (SEQ ID NO: 1460) |
| ABE72276 | 28 | LANASNDSSSHLQLIYNLTLCELNGTDWLANKFD | 61 | (SEQ ID NO: 1461) |
| ABE72277 | 28 | LANASNDSSSHLQLIYNLTLCELNGTDWLANKFD | 61 | (SEQ ID NO: 1462) |
| ABE72280 | 28 | LVNASNNSSSHLQLIYNLTLCELNGTDWLANKFD | 61 | (SEQ ID NO: 1463) |
| ABE72281 | 28 | LANASNDSSSHLQLIYNLTLCELNGTDWLANKFD | 61 | (SEQ ID NO: 1464) |
| ABE72282 | 28 | LANASNNSSSHLQLIYNLTLCELNGTDWLADKFD | 61 | (SEQ ID NO: 1465) |
| ABE72287 | 28 | LANASDNSSSHLQLIYNLTLCELNGTDWLTNKFD | 61 | (SEQ ID NO: 1466) |
| ABE72288 | 28 | LANASNNSSSHLQLIYNLTLCELNGTDWLANKFD | 61 | (SEQ ID NO: 1467) |
| ABE72289 | 28 | LANANNDSSSHLQLIYNLTLCELNGTDWLANKFD | 61 | (SEQ ID NO: 1468) |
| ABE72302 | 28 | PANASNDSSSHLQLIYNLTLCELNGTDWLAKKFD | 61 | (SEQ ID NO: 1469) |
| ABE72305 | 28 | LANASNNSSSHLQLIYNLTLCELNGTDWLAKKFD | 61 | (SEQ ID NO: 1470) |
| ABE72307 | 28 | LVNANSSSSSHFQLIYNLTLCELNGTDWLASKFD | 61 | (SEQ ID NO: 1471) |
| ABE72308 | 28 | LVNANSNSSSHFQLIYNLTLCELNGTDWLANKFD | 61 | (SEQ ID NO: 1472) |
| ABE72319 | 28 | LVNANSNSSSHLQLIYNLTLCELNGTDWLADKFD | 61 | (SEQ ID NO: 1473) |
| ABE72320 | 28 | LVNANSNSSSHLQLIYNLTLCELNGTDWLANKFD | 61 | (SEQ ID NO: 1474) |
| ABE72322 | 28 | LVNANSNSSSHFQLIYNLTLCELNGTDWLADKFD | 61 | (SEQ ID NO: 1475) |
| ABE72324 | 28 | LVNANSNSSSHFQLIYNLTLCELNGTDWLAKKFD | 61 | (SEQ ID NO: 1476) |
| ABE72325 | 28 | LANASNDSSSHLQLIYNLTLCELNGTDWLANKFD | 61 | (SEQ ID NO: 1477) |
| ABE72326 | 28 | LANASNDSSSHLQLIYNLTLCELNGTDWLANKFD | 61 | (SEQ ID NO: 1478) |
| ABE72329 | 28 | LANASNDSSSHLQLIYNLTLCELNGTDWLANKFD | 61 | (SEQ ID NO: 1479) |
| ABE72330 | 28 | LVNANSNSSSHFQLIYNLTLCELNGTDWLANKFD | 61 | (SEQ ID NO: 1480) |
| ABE72331 | 28 | LVSANSNSSSHLQLIYNLTLCELNGTDWLASRFD | 61 | (SEQ ID NO: 1481) |
| ABE72336 | 28 | LANASNNSSSHLQLIYNLTLCELNGTDWLANKFD | 61 | (SEQ ID NO: 1482) |
| ABE72337 | 28 | LANASNNSSSHLQLIYNLTLCELNGTDWLANKFD | 61 | (SEQ ID NO: 1483) |
| ABE72339 | 28 | LANASSDSSSHLQLIYNLTLCELNGTDWLANKFD | 61 | (SEQ ID NO: 1484) |
| ABE72341 | 28 | LVNANSSSSSHLQLIYNLTLCELNGTDWLAGKFD | 61 | (SEQ ID NO: 1485) |
| ABE72345 | 28 | LVNANSTSSSHLQLIYNLTLCELNGTDWLANKFD | 61 | (SEQ ID NO: 1486) |
| ABE72350 | 28 | LANASNDSSSHLQLIYNLTLCELNGTDWLANKFD | 61 | (SEQ ID NO: 1487) |
| ABE72351 | 28 | LANASNDSSSHLQLIYNLTLCELNGTDWLANKFD | 61 | (SEQ ID NO: 1488) |
| ABE72354 | 28 | LANASNDSSSHLQLIYNLTLCELNGTDWLANKFD | 61 | (SEQ ID NO: 1489) |
| ABE72355 | 28 | LANASNNSSSHLQLIYNLTLCELNGTDWLANKFD | 61 | (SEQ ID NO: 1490) |
| ABE72357 | 28 | LANASNNSSSHLQLIYNLTLCELNGTDWLADKFD | 61 | (SEQ ID NO: 1491) |
| ABE72358 | 28 | LVNANSNSSSHLQLIYNLTLCELNGTDWLANKFD | 61 | (SEQ ID NO: 1492) |

FIG. 3 (con't)

| | | | | |
|---|---|---|---|---|
| ABE72365 | 28 | LVNAGSNSSSHLQLIYNLTICELNGTDWLNNHFS | 61 | (SEQ ID NO: 1493) |
| ABE72367 | 28 | LANASNDSSSHLQLIYNLTLCELNGTDWLANKFD | 61 | (SEQ ID NO: 1494) |
| ABE72368 | 28 | LANASNDSSSHLQLIYNLTLCELNGTDWLANKFD | 61 | (SEQ ID NO: 1495) |
| ABE72370 | 28 | LANASNDSSSHLQLIYNLTLCELNGTDWLANKFD | 61 | (SEQ ID NO: 1496) |
| ABE72376 | 28 | LVNADSNSSSHLQLIYNLTICELNGTEWLNNHFS | 61 | (SEQ ID NO: 1497) |
| ABE72378 | 28 | LANASNNSSSHLQLIYNLTLCELNGTDWLANKFD | 61 | (SEQ ID NO: 1498) |
| ABE72399 | 28 | LVNASSNSSSHLQLIYNLTLCELNGTDWLKDKFD | 61 | (SEQ ID NO: 1499) |
| ABE72402 | 28 | LVNANSNSSSHLQLIYNLTLCELNGTDWLKDKFD | 61 | (SEQ ID NO: 1500) |
| ABE72403 | 28 | LVNANSNRSSHLQLIYNLTLCELNGTDWLKDKFD | 61 | (SEQ ID NO: 1501) |
| ABE72404 | 28 | LVNANSNSSSHLQLIYNLTLCELNGTDWLRDKFD | 61 | (SEQ ID NO: 1502) |
| ABE72412 | 28 | LVNANSNSSSHLQLIYNLTLCELNGTDWLKDKFD | 61 | (SEQ ID NO: 1503) |
| ABE72417 | 28 | LVNASSNSSSHLQLIYNLTLCELNGTDWLKNKFD | 61 | (SEQ ID NO: 1504) |
| ABE72419 | 28 | LVNANSSSSSHFQLIYNLTLCELNGTDWLANKFD | 61 | (SEQ ID NO: 1505) |
| ABE72421 | 28 | LVNANSNSSSHLQLIYNLTLCELNGTDWLKDKFD | 61 | (SEQ ID NO: 1506) |
| ABE72425 | 28 | LVNANSTSSSHFQLIYNLTLCELNGTDWLANKFD | 61 | (SEQ ID NO: 1507) |
| ABE72426 | 28 | LVNASSNSSSHLQLIYNLTICELNGTDWLNNHFS | 61 | (SEQ ID NO: 1508) |
| ABE72430 | 28 | PVNANNTSSSHFQSIYNLTLCELNGTDWLASHFD | 61 | (SEQ ID NO: 1509) |
| ABE72433 | 28 | LVNASNNNSSHLQLIYNLTICELNGTDWLNNKFD | 61 | (SEQ ID NO: 1510) |
| ABE72434 | 28 | LVNASNNNSSHLQLIYNLTICELNGTDWLNNKFD | 61 | (SEQ ID NO: 1511) |
| ABE72437 | 28 | LVNANSNSSSHLQLIYNLTICELNGTDWLNNHFS | 61 | (SEQ ID NO: 1512) |
| ABE72438 | 28 | LVNASXNSSSHLQLIYNLTICELNGTEWLNNHFS | 61 | (SEQ ID NO: 1513) |
| ABE72442 | 28 | LVNASSNSSSHLQLIYNLTICELNGTDWLNSHFS | 61 | (SEQ ID NO: 1514) |
| ABE72444 | 28 | LVNAXSNSSSHLQLIYNLTLCELNGTDWLRDKFD | 61 | (SEQ ID NO: 1515) |
| ABE72449 | 28 | LVNASSNSSSHLQLIYNLTICELNGTGWLNNHFS | 61 | (SEQ ID NO: 1516) |
| ABE72454 | 28 | LVNAXGNSSSHLQLIYNLTICELNGTDWLNDHFS | 61 | (SEQ ID NO: 1517) |
| ABE72457 | 28 | LVNANSNSSSHLQLIYNLTICELNGTDWLNNHFS | 61 | (SEQ ID NO: 1518) |
| ABE72458 | 28 | LVNANSSSSSHFQLIYNLTLCELNGTDWLANKFD | 61 | (SEQ ID NO: 1519) |
| ABE72462 | 28 | LVNASGNSSSHLQLIYNLTICELNGTDWLNNKFD | 61 | (SEQ ID NO: 1520) |
| ABE72466 | 28 | LVNADSSSSSHLQLIYNLTICELNGTDWLNTKFD | 61 | (SEQ ID NO: 1521) |
| ABE72469 | 28 | LVNASNXSSSHLQLIYNLTICELNGTDWLNEHFS | 61 | (SEQ ID NO: 1522) |
| ABE72479 | 28 | LVNASNNSSSHLQLIYNLTICELNGTDWLNKSFD | 61 | (SEQ ID NO: 1523) |
| ABE72481 | 28 | LVNANSNSSSHLQLIYNLTLCELNGTDWLKDKFD | 61 | (SEQ ID NO: 1524) |
| ABE72484 | 28 | LVNASNSNSSHLQLIYNLTLCELNGTDWLANKFD | 61 | (SEQ ID NO: 1525) |
| ABE72487 | 28 | LVNAGNHSSSHLQLIYNLTICELNGTDWLNNRFS | 61 | (SEQ ID NO: 1526) |
| ABE72489 | 28 | LVNANSSSSSHFQLIYNLTLCELNGTDWLANRFD | 61 | (SEQ ID NO: 1527) |
| ABE72492 | 28 | LVNASNNNSSHLQLIYNLTICELNGTDWLNDHFS | 61 | (SEQ ID NO: 1528) |
| ABE72493 | 28 | LVNASNSSSSHLQLIYNLTLCELNGTDWLANKFD | 61 | (SEQ ID NO: 1529) |
| ABE72495 | 28 | LVNAXSNNSSHLQLIYNLTICELNGTDWLNEHFS | 61 | (SEQ ID NO: 1530) |
| ABE72496 | 28 | LVNAKSNSSSHLQLIYNLTICELNGTDWLNNHFS | 61 | (SEQ ID NO: 1531) |
| ABE72497 | 28 | LVNANSNSSSHLQSIYNLTICELNGTDWLNSHFS | 61 | (SEQ ID NO: 1532) |
| ABE72500 | 28 | LVNANSSSSSHIQLIYNLTLCELNGTDWLANKFD | 61 | (SEQ ID NO: 1533) |
| ABE72504 | 28 | LVNASSNGSSHLQLIYNLTLCELNGTDWLKNKFD | 61 | (SEQ ID NO: 1534) |
| ABE72507 | 28 | LVNASSNSSSHLQLIYNLTLCELNGTDWLKDKFD | 61 | (SEQ ID NO: 1535) |
| ABE72510 | 28 | LANASNGSSSHLQLIYNLTLCELNGTDWLANKFD | 61 | (SEQ ID NO: 1536) |
| ABE72514 | 28 | LVNADSNNSSQLQLIYNLTICELNGTDWLDNHFS | 61 | (SEQ ID NO: 1537) |
| ABE72515 | 28 | LVNASNNSSSHLQLIYNLTICELNGTDWLNNHFS | 61 | (SEQ ID NO: 1538) |
| ABE72516 | 28 | LVNASSNSSSHLQLIYNLTICELNGTGWLNDHFS | 61 | (SEQ ID NO: 1539) |
| ABE72519 | 28 | LANANNDSSSHLQLIYNLTLCELNGTDWLANKFD | 61 | (SEQ ID NO: 1540) |
| ABE72521 | 28 | LVNADSNNSSHLQLIYKLTICELNGTDWLDNHFS | 61 | (SEQ ID NO: 1541) |
| ABE72528 | 28 | LVNANSNSSSHLQLIYNLTLCELNGTDWLEGKFD | 61 | (SEQ ID NO: 1542) |
| ABE72531 | 28 | LVNADSNNSSHLQLIYNLTICELNGTDWLNEHFS | 61 | (SEQ ID NO: 1543) |
| ABE72534 | 28 | LVNANSNSSSHLQLIYNLTICELNGTDWLDSHFS | 61 | (SEQ ID NO: 1544) |
| ABE72537 | 28 | LVNASSNSSSHLQLIYNLTICELNGTDWLDNHFS | 61 | (SEQ ID NO: 1545) |
| ABE72538 | 28 | LVNAENNSSSHLQLIYNLTICELNGTDWLNRKFD | 61 | (SEQ ID NO: 1546) |
| ABE72540 | 28 | LVNASSNSSSHLQLIYNLTLCELNGTDWLKDKFD | 61 | (SEQ ID NO: 1547) |

FIG. 3 (con't)

| | | | | |
|---|---|---|---|---|
| ABE72551 | 30 | SFVDGNDTNSTYQYIYNLTICELNGTNWLSNHFE | 63 | (SEQ ID NO: 1548) |
| ABE72552 | 28 | LVNASSNSSSHLQLIYNLTICELNGTDWLNNHFS | 61 | (SEQ ID NO: 1549) |
| ABE72553 | 28 | LVNASGNSSSHLQLIYNLTICELNGTDWLDKHFS | 61 | (SEQ ID NO: 1550) |
| ABE72558 | 28 | LVNANSNSSSHLQLIYNLTLCELNGTDWLKDKFD | 61 | (SEQ ID NO: 1551) |
| ABE72565 | 28 | LVNANSNGSSHLQLIYNLTLCELNGTDWLANRFD | 61 | (SEQ ID NO: 1552) |
| ABE72566 | 28 | LVNANSNSSSHFQLIYNLTLCELNGTDWLANRFD | 61 | (SEQ ID NO: 1553) |
| ABE72568 | 28 | LVNANSNSSSHIQLIYNLTLCELNGTDWLANKFD | 61 | (SEQ ID NO: 1554) |
| ABE72570 | 28 | LVNANSDNSSHLQLIYNLTICELNGTDWLNEHFS | 61 | (SEQ ID NO: 1555) |
| ABE72571 | 28 | LVNASSNSSSHLQLIYNLTICELNGTDWLNNHFS | 61 | (SEQ ID NO: 1556) |
| ABE72572 | 28 | LVNANSSSSSHFQLIYSLTLCELNGTDWLANKFD | 61 | (SEQ ID NO: 1557) |
| ABE72574 | 28 | LVNASSNSSSHLQLIYNLTICELNGTDWLNSHFS | 61 | (SEQ ID NO: 1558) |
| ABE72579 | 28 | LVNASNNSSSHFQLIYNLTICELNGTDWLNNHFS | 61 | (SEQ ID NO: 1559) |
| ABE72581 | 28 | LVNASSNSSSHLQLIYNLTLCELNGTDWLRNKFD | 61 | (SEQ ID NO: 1560) |
| ABE72582 | 28 | LVNANSSSSSHFQLIYNLTLCELNGTDWLNKHFN | 61 | (SEQ ID NO: 1561) |
| ABE72583 | 28 | LVNANSDSSSHLQLIYNLTICELNGTDWLDEHFS | 61 | (SEQ ID NO: 1562) |
| ABE72592 | 28 | LVDANSNSSSHLQLIYNLTLCELNGTDWLANRFD | 61 | (SEQ ID NO: 1563) |
| ABE72593 | 28 | LVNANGNSSSHLQLIYNLTICELNGTDWLNNHFS | 61 | (SEQ ID NO: 1564) |
| ABE72598 | 28 | LVNANSNGSSHLQLIYNLTLCELNGTDWLANRFD | 61 | (SEQ ID NO: 1565) |
| ABE72600 | 28 | LANASNNSSSHLQLIYNLTLCELNGTDWLANKFD | 61 | (SEQ ID NO: 1566) |
| ABE72601 | 28 | LVNANSNSSSHFQLIYNLTLCELNGTDWLASKFD | 61 | (SEQ ID NO: 1567) |
| ABE72602 | 28 | LVNANSNSSSHLQLIYNLTICELNGTEWLGSHFS | 61 | (SEQ ID NO: 1568) |
| ABE72604 | 28 | LVNANSNGSSHLQLIYNLTLCELNGTDWLANRFD | 61 | (SEQ ID NO: 1569) |
| ABE72605 | 28 | LVNANSNSSSHFQLIYNLTICELNGTEWLSKHFS | 61 | (SEQ ID NO: 1570) |
| ABE72609 | 28 | LVNADHNSSSHLQLIYNLTICELNGTDWLDKKFD | 61 | (SEQ ID NO: 1571) |
| ABE72610 | 28 | LVNADHNSSSHLQLIYNLTICELNGTDWLDKKFD | 61 | (SEQ ID NO: 1572) |
| ABE72612 | 28 | LVNANSSSSSHLQLIYNLTLCELNGTDWLKDKFD | 61 | (SEQ ID NO: 1573) |
| ABE72613 | 28 | LVNANSNSSSHLQLIYNLTICELNGTDWLNNHFS | 61 | (SEQ ID NO: 1574) |
| ABE72614 | 28 | LANASBDSSSHLQLIYNLTLCELNGTDWLANKFD | 61 | (SEQ ID NO: 1575) |
| ABE72616 | 28 | LVNASNNSSSHLQLIYNLTICELNGTDWLNEHFS | 61 | (SEQ ID NO: 1576) |
| ABE72617 | 28 | LVNASSNSSSHLQLIYNLTICELNGTDWLNNHFS | 61 | (SEQ ID NO: 1577) |
| ABE72618 | 28 | LVNADSNSSSHLQLIYNLTICELNGTDWLNNHFG | 61 | (SEQ ID NO: 1578) |
| ABE72619 | 28 | LANASNNSSSHLQLIYNLTLCELNGTDWLANKFD | 61 | (SEQ ID NO: 1579) |
| ABE72620 | 28 | LVNANSNNSSHLQLIYNLTICELNGTDWLNEHFS | 61 | (SEQ ID NO: 1580) |
| ABE72626 | 28 | LVNANSNNSSHLQLIYNLTICELNGTDWLNKHFS | 61 | (SEQ ID NO: 1581) |
| ABE72627 | 28 | LVNANSNSSSHLQLIYNLTLCELNGTDWLANRFD | 61 | (SEQ ID NO: 1582) |
| ABE72628 | 28 | LVNASGNSSSHLQLIYNLTICELNGTDWLNNKFD | 61 | (SEQ ID NO: 1583) |
| ABE72629 | 28 | LVNANSNSSSHLQLIYNLTICELNGTDWLNKKFD | 61 | (SEQ ID NO: 1584) |
| ABE72631 | 28 | LVNASSNSSSHLQLIYNLTICELNGTDWLNSQFS | 61 | (SEQ ID NO: 1585) |
| ABE72632 | 28 | LVNADSNNSSQLQLIYNLTICELNGTDWLDNHFS | 61 | (SEQ ID NO: 1586) |
| ABE72633 | 28 | LVNANSNSSSHLQLIYNLTLCELNGTEWLAGRFD | 61 | (SEQ ID NO: 1587) |
| ABE72635 | 28 | LVNASNHSSSHLQLIYNLTICELNGTDWLNNHFS | 61 | (SEQ ID NO: 1588) |
| ABE72636 | 28 | LVNADSNNSSQLQLIYNLTICELNGTDWLNNHFS | 61 | (SEQ ID NO: 1589) |
| ABE72637 | 28 | LVNADSNNSSQLQLIYNLTICELNGTDWLNNHFS | 61 | (SEQ ID NO: 1590) |
| ABE72644 | 28 | LVNANSSSSSHLQLIYNLTLCELNGTDWLKNKFD | 61 | (SEQ ID NO: 1591) |
| ABE72647 | 28 | LVNADSNSSSHLQLIYNLTICELNGTDWLNNHFS | 61 | (SEQ ID NO: 1592) |
| ABE72651 | 28 | LANADNNSSSHLQLIYNLTLCELNGTDWLANKFD | 61 | (SEQ ID NO: 1593) |
| ABE72658 | 28 | LVNADSNNSSHLQLIYNLTICELNGTDWLDKHFS | 61 | (SEQ ID NO: 1594) |
| ABE72659 | 28 | LVNANSNSSSHLQLIYNLTLCELNGTDWLANRFD | 61 | (SEQ ID NO: 1595) |
| ABE72662 | 28 | LANASNDSSSHLQLIYNLTLCELNGTDWLANKFD | 61 | (SEQ ID NO: 1596) |
| ABE72663 | 28 | LVNASSNSSSHLQLIYNLTICELNGTDWLNDHFS | 61 | (SEQ ID NO: 1597) |
| ABE72670 | 28 | LVNANSTSSSYSQLIYNLTLCELNGTDWLNGHFS | 61 | (SEQ ID NO: 1598) |
| ABE72671 | 28 | LANADNNSSSHLQLIYNLTLCELNGTDWLADKFD | 61 | (SEQ ID NO: 1599) |
| ABE72673 | 28 | LVNASSNSSSHLQLIYNLTICELNGTDWLNSHFS | 61 | (SEQ ID NO: 1600) |
| ABE72674 | 28 | LVNASGNSSSHFQLIYNLTICELNGTGWLNDHFS | 61 | (SEQ ID NO: 1601) |
| ABE72679 | 28 | LVNARSNSSSHLQLIYNLTICELNGTDWLNNHFS | 61 | (SEQ ID NO: 1602) |

FIG. 3 (con't)

| | | | | |
|---|---|---|---|---|
| ABE72680 | 28 | LVNASSNSSSHLQLIYNLTICELNGTDWLNSHFS | 61 | (SEQ ID NO: 1603) |
| ABE72684 | 28 | LVNASSNSSSHIQLIYNLTLCELNGTDWLSGKFD | 61 | (SEQ ID NO: 1604) |
| ABE72686 | 28 | LVNASSNSSSHLQLIYNLTICELNGTDWLNNHFS | 61 | (SEQ ID NO: 1605) |
| ABE72687 | 28 | LVNASSNSSSHLQLIYNLTICELNGTDWLNNHFS | 61 | (SEQ ID NO: 1606) |
| ABE72694 | 28 | LVNANSNHSSHFQLIYNLTLCELNGTDWLANKFD | 61 | (SEQ ID NO: 1607) |
| ABE72699 | 28 | LVNASNBSSSHLQLIYNLTICELNGTDWLNEHFS | 61 | (SEQ ID NO: 1608) |
| ABE72701 | 28 | LVNANSNSSSHLQSIYNLTICELNGTEWLDEHFS | 61 | (SEQ ID NO: 1609) |
| ABE72704 | 28 | LVNASSNNSSHLQLIYNLTICELNGTDWLDRHFG | 61 | (SEQ ID NO: 1610) |
| ABE72706 | 28 | LVNASSNSSSHLQLIYNLTICELNGTDWLNGHFS | 61 | (SEQ ID NO: 1611) |
| ABE72712 | 28 | LVNASSNSSSHLQLIYNLTICELNGTDWLNNHFS | 61 | (SEQ ID NO: 1612) |
| ABE72714 | 28 | LVNANSNSSSHLQLIYNLTLCELNGTDWLKGKFN | 61 | (SEQ ID NO: 1613) |
| ABE72715 | 28 | LVNANSNSSSHLQLIYNLTICELNGTDWLNNHFS | 61 | (SEQ ID NO: 1614) |
| ABE72719 | 28 | LVNASSNSSSHLQLIYNLTICELNGTDWLNNHFS | 61 | (SEQ ID NO: 1615) |
| ABE72727 | 28 | LVNASNGSSSHLQLIYNLTLCELNGTDWLANKFD | 61 | (SEQ ID NO: 1616) |
| ABE72728 | 28 | LVSANGNSSSHLQLIYNLTICELNGTDWLNNHFS | 61 | (SEQ ID NO: 1617) |
| ABE72730 | 28 | LVNADSNSSSHLQLIYNLTLCELNGTDWLKDKFD | 61 | (SEQ ID NO: 1618) |
| ABE72731 | 28 | LVNANSNSSSHLQLIYNLTLCELNGTDWLKDKFN | 61 | (SEQ ID NO: 1619) |
| ABE72737 | 28 | LVNAGNSSSSHLQLIYNLTICELNGTDWLKNHFS | 61 | (SEQ ID NO: 1620) |
| ABE72740 | 28 | LANASGNSSSHLQLIYNLTLCELNGTDWLADKFD | 61 | (SEQ ID NO: 1621) |
| ABE72741 | 28 | LVNANNDSSSHLQLIYNLTICELNGTDWLGNKFD | 61 | (SEQ ID NO: 1622) |
| ABE72745 | 28 | LVNANSNSSSHLQSIYNLTICELNGTDWLNNHFS | 61 | (SEQ ID NO: 1623) |
| ABE72746 | 28 | LVNANSNSSSHFQLIYNLTLCELNGTEWLSNKFD | 61 | (SEQ ID NO: 1624) |
| ABE72747 | 28 | LVNASNSSSSHLQLIYNLTICELNGTDWLNNHFS | 61 | (SEQ ID NO: 1625) |
| ABE72748 | 28 | LVNANSNSSSHLQLIYNLTICELNGTDWLNEHFS | 61 | (SEQ ID NO: 1626) |
| ABE72749 | 28 | LVNAHGNSSSHLQLIYNLTICELNGTDWLNNHFS | 61 | (SEQ ID NO: 1627) |
| ABE72754 | 28 | LVNANSNSSSHLQLIYNLTLCELNGTDWLKDKFD | 61 | (SEQ ID NO: 1628) |
| ABE72755 | 28 | LVNASNSSSSHLQLIYNLTICELNGTDWLNNHFS | 61 | (SEQ ID NO: 1629) |
| ABE72757 | 28 | LVNANSNSSSHLQLIYNLTICELNGTDWLNSHFS | 61 | (SEQ ID NO: 1630) |
| ABE72758 | 28 | LANASNNSSSHLQLIYNLTLCELNGTDWLADKFD | 61 | (SEQ ID NO: 1631) |
| ABE72760 | 28 | LVNASSNSSSHLQLIYNLTICELNGTDWLNNHFS | 61 | (SEQ ID NO: 1632) |
| ABE72761 | 28 | LVNASSNSSSHLQLIYNLTICELNGTDWLNEKFD | 61 | (SEQ ID NO: 1633) |
| ABE72762 | 28 | LVNASSNSSSHFQLIYNLTICELNGTDWLNNHFS | 61 | (SEQ ID NO: 1634) |
| ABE72763 | 28 | LVNADNSSSSHFQLIYNLTLCELNGTEWLANKFD | 61 | (SEQ ID NO: 1635) |
| ABE72765 | 28 | LVNANSSSSSHFQLIYNLTLCELNGTDWLADRFD | 61 | (SEQ ID NO: 1636) |
| ABE72767 | 28 | LVNASDNSSSHFQLIYNLTLCELNGTDWLANKFD | 61 | (SEQ ID NO: 1637) |
| ABE72768 | 28 | LVNASNDSSSHLQLIYNLTLCELNGTDWLANKFD | 61 | (SEQ ID NO: 1638) |
| ABE72769 | 28 | LVNASSNSSSHLQLIYNLTICELNGTDWLNNHFS | 61 | (SEQ ID NO: 1639) |
| ABE72771 | 28 | LVNASSDSSSHLQLIYNLTICELNGTDWLNGHFS | 61 | (SEQ ID NO: 1640) |
| ABE72773 | 28 | LVNASSNSSSHLQLIYNLTICELNGTDWLDEHFS | 61 | (SEQ ID NO: 1641) |
| ABE72776 | 28 | LANAHSDNSSHLQLIYNLTICELNGTDWLNKHFS | 61 | (SEQ ID NO: 1642) |
| ABE72778 | 28 | LVNANSNSSSHLQLIYNLTLCELNGTDWLKDKFD | 61 | (SEQ ID NO: 1643) |
| ABE72779 | 28 | LVNARGNSSSHLQLIYNLTICELNGTDWLNNHFS | 61 | (SEQ ID NO: 1644) |
| ABE72782 | 28 | LVNANSDSSSHLQLIYNLTICELNGTDWLNNHFS | 61 | (SEQ ID NO: 1645) |
| ABE72790 | 28 | LVNANSNSSSHLQLIYNLTICELNGTDWLNKHFS | 61 | (SEQ ID NO: 1646) |
| ABE72793 | 28 | LVNASGNSSSHLQLIYNLTICELNGTDWLNDHFS | 61 | (SEQ ID NO: 1647) |
| ABE72794 | 28 | LVNASNDSSSHLQLIYNLTICELNGTDWLNSHFS | 61 | (SEQ ID NO: 1648) |
| ABE72797 | 28 | LVNANSNSSSHLQLIYNLTLCELNGTDWLKNKFD | 61 | (SEQ ID NO: 1649) |
| ABE72799 | 30 | SFADGNGNNSTYQYIYNLTICELNGTNWLSDHFE | 63 | (SEQ ID NO: 1650) |
| ABE72800 | 28 | LVNASSNSSSHLQLIYNLTLCELNGTDWLKDKFD | 61 | (SEQ ID NO: 1651) |
| ABE72801 | 28 | LVNANSNSSSHLQLIYNLTLCELNGTDWLKDKFD | 61 | (SEQ ID NO: 1652) |
| ABE72802 | 28 | LVNANSNSSSHLQLIYNLTLCELNGTDWLKDKFD | 61 | (SEQ ID NO: 1653) |
| ABE72804 | 28 | LVNASSNSSSHLQLIYNLTICELNGTEWLSNHFS | 61 | (SEQ ID NO: 1654) |
| ABE72806 | 28 | LVNANSNSSSHIQLIYNLTLCELNGTDWLANKFD | 61 | (SEQ ID NO: 1655) |
| ABE72808 | 28 | LVNAXXXSSSHLQLIYNLTICELNGTDWLNNHFS | 61 | (SEQ ID NO: 1656) |
| ABE72809 | 28 | LVNANSNSSSHLQSIYNLTICELNGTDWLNNHFS | 61 | (SEQ ID NO: 1657) |

FIG. 3 (con't)

| | | | | |
|---|---|---|---|---|
| ABE72817 | 28 | LANASNNSSSHLQLIYNLTLCELNGTDWLANKFD | 61 | (SEQ ID NO: 1658) |
| ABE72821 | 28 | LVNADSNSSSHLQLIYNLTICELNGTDWLNNHFS | 61 | (SEQ ID NO: 1659) |
| ABE72822 | 28 | LVNASSNSSSHLQLIYNLTICELNGTDWLNNHFS | 61 | (SEQ ID NO: 1660) |
| ABE72823 | 28 | LVNASSNSSSHLQLIYNLTICELNGTDWLNDHFS | 61 | (SEQ ID NO: 1661) |
| ABE72832 | 28 | LVNASGNSSSHLQLIYNLTICELNGTDWLNNHFS | 61 | (SEQ ID NO: 1662) |
| ABE72834 | 28 | LVNASGNSSSHLQLIYNLTICELNGTDWLDNHFS | 61 | (SEQ ID NO: 1663) |
| ABE72838 | 28 | LVNASSNSSSHLQLIYNLTICELNGTDWLNDHFS | 61 | (SEQ ID NO: 1664) |
| ABE72842 | 28 | LVNADSNSSSHLQLIYNLTICELNGTEWLNNRFS | 61 | (SEQ ID NO: 1665) |
| ABE72843 | 28 | LVNASNDSSSHLQLIYNLTICELNGTDWLDNKFD | 61 | (SEQ ID NO: 1666) |
| ABE72846 | 28 | LVNASGNSSSHLQLIYNLTICELNGTDWLNDHFS | 61 | (SEQ ID NO: 1667) |
| ABE72850 | 28 | LVNANSNSSSHLQLIYNLTICELNGTDWLNDHFS | 61 | (SEQ ID NO: 1668) |
| ABE72857 | 28 | LVNANSNSSSHLQLIYNLTLCELNGTQWLAGRFD | 61 | (SEQ ID NO: 1669) |
| ABE72863 | 28 | LVNANSNSSSHLQLIYNLTLCELNGTDWLKDKFD | 61 | (SEQ ID NO: 1670) |
| ABE73142 | 28 | LANASNDSSSHLQLIYNLTLCELNGTDWLANKFD | 61 | (SEQ ID NO: 1671) |
| ABF15094 | 28 | LANANSNSSSHLQLIYNLTLCELNGTDWLANRFD | 61 | (SEQ ID NO: 1672) |
| ABF15097 | 27 | LANASRNSSSHLQLIYNLTLCELNGTDWLADKFD | 60 | (SEQ ID NO: 1673) |
| ABF15099 | 28 | LVNASSNSSSHLQLIYNLTICELNGTDWLNDKFD | 61 | (SEQ ID NO: 1674) |
| ABF15100 | 28 | LVNASNNSSSHLQLIYNLTICELNGTDWLNNKFD | 61 | (SEQ ID NO: 1675) |
| ABF15101 | 19 | LVNANSNSSSHLQLIYNLTICELNGTDWLDDKFD | 52 | (SEQ ID NO: 1676) |
| ABF15102 | 28 | LVNASSNSSSHLQLIYNLTICELNGTDWLNDKFD | 61 | (SEQ ID NO: 1677) |
| ABF15103 | 28 | LANASDNSSSHLQLIYNLTLCELNGTDWLAGKFD | 61 | (SEQ ID NO: 1678) |
| ABF15105 | 26 | LANASDNSSSHLQLIYNLTLCELNGTDWLAGKFD | 59 | (SEQ ID NO: 1679) |
| ABF15106 | 28 | LANASNNSSSHLQLIYNLTLCELNGTDWLANKFD | 61 | (SEQ ID NO: 1680) |
| ABF15107 | 28 | LVNANSNSSSHLQLIYNLTICELNGTDWLKEKFD | 61 | (SEQ ID NO: 1681) |
| ABF15108 | 28 | LANASDNSSSHLQLIYNLTLCELNGTDWLAGKFD | 61 | (SEQ ID NO: 1682) |
| ABF15109 | 28 | PANASNGSSSHLQLIYNLTLCELNGTDWLANKFD | 61 | (SEQ ID NO: 1683) |
| ABF15111 | 28 | PANAGNDSSSHLQLIYNLTLCELNGTDWLANKFD | 61 | (SEQ ID NO: 1684) |
| ABF15114 | 28 | LANASNNSSSHLQLIYNLTLCELNGTDWLANKFD | 61 | (SEQ ID NO: 1685) |
| ABF15117 | 28 | LVSAHSNSSSHLQLIYNLTLCELNGTDWLANKFD | 61 | (SEQ ID NO: 1686) |
| ABF15119 | 28 | LANASANSSSHLQLIYNLTLCELNGTDWLADKFD | 61 | (SEQ ID NO: 1687) |
| ABF15120 | 28 | LVNAGNNSSSHLQLIYNLTLCELNGTDWLANKFD | 61 | (SEQ ID NO: 1688) |
| ABF15123 | 23 | LANANSNSSSHLQLIYNLTLCELNGTDWLADRFD | 56 | (SEQ ID NO: 1689) |
| ABF15124 | 23 | LANANSNSSSHLQLIYNLTLCELNGTDWLADRFD | 56 | (SEQ ID NO: 1690) |
| ABF15125 | 28 | PANASNDSSSHLQLIYNLTLCELNGTDWLANKFD | 61 | (SEQ ID NO: 1691) |
| ABF15129 | 19 | LVNANSNSSSHLQLIYNLTICELNGTDWLNDKFD | 52 | (SEQ ID NO: 1692) |
| ABF15132 | 24 | LANASNNSSSHLQLIYNLTLCELNGTDWLANKFD | 57 | (SEQ ID NO: 1693) |
| ABF15133 | 28 | LANASNNSSSHLQLIYNLTLCELNGTDWLANKFD | 61 | (SEQ ID NO: 1694) |
| ABF15137 | 27 | LANASDNSSSHLQLIYNLTLCELNGTDWLANKFD | 60 | (SEQ ID NO: 1695) |
| ABF15141 | 23 | LANASNNSSSHLQLIYNLTLCELNGTDWLANKFD | 56 | (SEQ ID NO: 1696) |
| ABF15146 | 28 | LANASANSSSHLQLIYNLTLCELNGTDWLADKFD | 61 | (SEQ ID NO: 1697) |
| ABF15148 | 28 | LANASNNSSSHLQLIYNLTLCELNGTDWLVNKFD | 61 | (SEQ ID NO: 1698) |
| ABF15150 | 24 | LANASNDSSSHLQLIYNLTLCELNGTDWLANKFD | 57 | (SEQ ID NO: 1699) |
| ABF15151 | 28 | LANADNNSSSHLQLIYNLTLCELNGTDWLANKFD | 61 | (SEQ ID NO: 1700) |
| ABF15153 | 24 | LANASNNSSSHLQLIYNLTLCELNGTDWLADKFD | 57 | (SEQ ID NO: 1701) |
| ABF15154 | 28 | LANASNNSSSHLQLIYNLTLCELNGTDWLANKFD | 61 | (SEQ ID NO: 1702) |
| ABF15155 | 28 | LANASNNSSSHLQLIYNLTLCELNGTDWLANKFD | 61 | (SEQ ID NO: 1703) |
| ABF15156 | 28 | LANASNNSSSHLQLIYNLTLCELNGTDWLANKFD | 61 | (SEQ ID NO: 1704) |
| ABF19742 | 28 | LVNANSNSSSHLQLIYNLTLCELNGTDWLAGRFD | 61 | (SEQ ID NO: 1705) |
| ABF19743 | 28 | LVNANSNSSSHLQLIYNLTLCELNGTDWLADNFD | 61 | (SEQ ID NO: 1706) |
| ABF19745 | 28 | LVNANSNSSSHLQLIYNLTLCELNGTDWLANRFD | 61 | (SEQ ID NO: 1707) |
| ABF19747 | 28 | LVNASSNSSSHLQLIYNLTLCELNGTDWLANRFD | 61 | (SEQ ID NO: 1708) |
| ABF19758 | 28 | LANANNDSSSHLQLIYNLTLCELNGTDWLANRFD | 61 | (SEQ ID NO: 1709) |
| ABF46652 | 28 | LVNASSNSSSHFQLIYNLTLCELNGTEWLADKFD | 61 | (SEQ ID NO: 1710) |
| ABF46658 | 28 | LVNANSNSSSHLQLIYNLTICELNGTDWLDNHFS | 61 | (SEQ ID NO: 1711) |
| ABF46661 | 28 | LVNASSNSSSHLQLIYNLTICELNGTDWLNNHFS | 61 | (SEQ ID NO: 1712) |

FIG. 3 (con't)

| | | | | |
|---|---|---|---|---|
| ABF46662 | 28 | LVNASGNSSSHLQLIYNLTICELNGTDWLNNHFS | 61 | (SEQ ID NO: 1713) |
| ABI24277 | 30 | SFADGNGDSSTYQYIYNLTICELNGTDWLSSHFG | 63 | (SEQ ID NO: 1714) |
| ABL86139 | 28 | LVNANSNSGSHLQLIYNLTLCELNGTDWLKDKFD | 61 | (SEQ ID NO: 1715) |
| ABL86141 | 28 | LVNANNDSSSHLQLIYSLTICELNGTEWLNEHFS | 61 | (SEQ ID NO: 1716) |
| ABL98045 | 28 | LVNASSNNSSHIQLIYNLTLCELNGTDWLAQKFD | 61 | (SEQ ID NO: 1717) |
| ABM91870 | 30 | SFADGNGNSSTYQYIYDLTICELNGTAWLSTHFS | 63 | (SEQ ID NO: 1718) |
| ABM91872 | 30 | SFADGNGNSSTYQYIYNLTICELNGTAWLSTHFS | 63 | (SEQ ID NO: 1719) |
| ABN80083 | 28 | LVNASNNNSSHIQLIYNLTLCELNGTDWLANKFD | 61 | (SEQ ID NO: 1720) |
| ABO31094 | 23 | LVNASNNSSSHIQLIYNLTLCELNGTDWLAQKFD | 56 | (SEQ ID NO: 1721) |
| ABO32601 | 30 | SFADGNGNSSTYQYIYNLTICELNGTEWLSNHFE | 63 | (SEQ ID NO: 1722) |
| ABO32602 | 30 | SFVAGSGNSSTYQYIYNLTICELNGTEWLSSHFD | 63 | (SEQ ID NO: 1723) |
| ABO32603 | 30 | SFVVGNGNSSTYQYIYNLTICELNGTTWLSSHFD | 63 | (SEQ ID NO: 1724) |
| ABO32604 | 30 | SFADGNGNSSTYQYIYNLTICELNGTEWLSSHFD | 63 | (SEQ ID NO: 1725) |
| ABO32605 | 30 | SFVDGNDNNSTYQYIYNLTICELNGTIWLSSHFV | 63 | (SEQ ID NO: 1726) |
| ABO32606 | 30 | SFADGNGNSSTYQYIYNLTICELNGTTWLSSHFS | 63 | (SEQ ID NO: 1727) |
| ABO32607 | 30 | SFADGNGNSSTYQYIYNLTICELNGTEWLSSHFD | 63 | (SEQ ID NO: 1728) |
| ABO32608 | 30 | SFADGNGNSSTYQYIYNLTICELNGTEWLSSHFD | 63 | (SEQ ID NO: 1729) |
| ABO32610 | 30 | SFADGNGNSSAYQYIYNLTICELNGTEWLSNHFS | 63 | (SEQ ID NO: 1730) |
| ABO32611 | 30 | SFVDGSDNSSTYQYIYNLTICELNGTAWLSGHFD | 63 | (SEQ ID NO: 1731) |
| ABO32612 | 30 | SFVDGSNNSSTYQYIYNLTICELNGTKWLSSHFD | 63 | (SEQ ID NO: 1732) |
| ABO32613 | 30 | SFADGNGNSSTYQYIYNLTICELNGTAWLSSHFD | 63 | (SEQ ID NO: 1733) |
| ABO32615 | 30 | SFVDGNDSSSTYQYIYNLTICELNGTEWLSSHFD | 63 | (SEQ ID NO: 1734) |
| ABO32618 | 30 | SFADGNGNSSTYQYIYNLTICELNGTEWLSSHFD | 63 | (SEQ ID NO: 1735) |
| ABO32619 | 30 | SFVDGNDNSSTYQYIYNLTICELNGTKWLSSHFD | 63 | (SEQ ID NO: 1736) |
| ABO93300 | 30 | SFADGNGNNSTYQYIYNLTICELNGTDWLSNHFS | 63 | (SEQ ID NO: 1737) |
| ABO93302 | 30 | SFVDGNGTNSTYQYIYNLTICELNGTHWLSDHFE | 63 | (SEQ ID NO: 1738) |
| ABO93304 | 30 | SFADGNGNNSTYQYIYNLTICELNGTDWLSGHFE | 63 | (SEQ ID NO: 1739) |
| BAA08286 | 28 | LVNASDSSSSHLQLIYNLTLCELNGTDWLADKFD | 61 | (SEQ ID NO: 1740) |
| BAA75259 | 28 | LVNANSNSSSHLQLIYNLTLCELNGTDWLANKFD | 61 | (SEQ ID NO: 1741) |
| BAE47009 | 28 | LVNANSSSSSHLQLIYNLTLCELNGTDWLAERFD | 61 | (SEQ ID NO: 1742) |
| BAE47011 | 28 | LVNANSNSSSHLQLIYNLTLCELNGTDWLAQKFD | 61 | (SEQ ID NO: 1743) |
| BAE47014 | 28 | LVNANSNSSSHLQLIYNLTLCELNGTDWLADKFD | 61 | (SEQ ID NO: 1744) |
| BAE47018 | 28 | LVNADSNSSSHLQLIYNLTLCELNGTDWLANKFD | 61 | (SEQ ID NO: 1745) |
| BAE47019 | 28 | LVNANSNSSSHFQLIYNMTLCELNGTDWLAGKFD | 61 | (SEQ ID NO: 1746) |
| BAE47021 | 28 | LVNANNSSSSHLQLIYNLTLCELNGTDWLANKFD | 61 | (SEQ ID NO: 1747) |
| BAE47022 | 28 | LVNANSDSSSHLQLIYNLTLCELNGTDWLANRFD | 61 | (SEQ ID NO: 1748) |
| BAE47023 | 28 | LVNANSSSSSHLQLIYNLTLCELNGTDWLANKFD | 61 | (SEQ ID NO: 1749) |
| BAE47027 | 28 | LVSANGNSSSHLQLIYNLTLCELNGTDWLADKFD | 61 | (SEQ ID NO: 1750) |
| BAE47028 | 28 | LVNANSSNSSHLQLIYNLTLCELNGTDWLANRFD | 61 | (SEQ ID NO: 1751) |
| BAE47029 | 28 | LVNANSTSSSHLQLIYNLTLCELNGTDWLANKFD | 61 | (SEQ ID NO: 1752) |
| BAE47031 | 28 | LVNANSNSSSHLQLIYNLTLCELNGTEWLADKFD | 61 | (SEQ ID NO: 1753) |
| BAE47032 | 28 | LVNANNSTSSHLQLIYNLTLCELNGTDWLADKFD | 61 | (SEQ ID NO: 1754) |
| BAE47033 | 28 | LVNANSDSSSHLQLIYNLTLCELNGTDWLAEKFD | 61 | (SEQ ID NO: 1755) |
| BAE47034 | 28 | LVNANSNSSSHLQLIYNLTLCELNGTDWLADRFD | 61 | (SEQ ID NO: 1756) |
| BAE47035 | 28 | LVNANSNSSSHFQLIYNLTLCELNGTDWLAQKFD | 61 | (SEQ ID NO: 1757) |
| BAE47036 | 28 | LVNANSNSSSHLQLIYNLTLCELNGTDWLANKFD | 61 | (SEQ ID NO: 1758) |
| BAE47037 | 28 | LVNANSSSSSHFQLIYNLTLCELNGTDWLANKFD | 61 | (SEQ ID NO: 1759) |
| CAA11082 | 30 | SFADGNGDSSTYQYIYNLTICELNGTDWLSSHFG | 63 | (SEQ ID NO: 1760) |
| CAA11094 | 28 | LANASTNSSSHLQLIYNLTLCELNGTDWLANRFD | 61 | (SEQ ID NO: 1761) |
| CAA11100 | 28 | LANASNNSSSHLQLIYNLTLCELNGTDWLANRFD | 61 | (SEQ ID NO: 1762) |
| CAA63493 | 30 | SFVAG-GSSSTYQYIYNLTICELNGTDWLSNHFD | 62 | (SEQ ID NO: 1763) |
| Q04569 | 30 | SFADGNGDSSTYQYIYNLTICELNGTDWLSSHFG | 63 | (SEQ ID NO: 1764) |

ORF-5 Proteins (GP5 Proteins)

FIG. 6

| Accession No. | GI No. | Accession No. | GI No. | Accession No. | GI No. |
|---|---|---|---|---|---|
| 1: EF175572 | gi:143351445 | 61: CS421730 | gi:115409843 | 121: AY739977 | gi:60266043 |
| 2: EF175570 | gi:143351411 | 62: DQ217415 | gi:78190884 | 122: AY739976 | gi:60266041 |
| 3: EF175568 | gi:143351350 | 63: DQ473474 | gi:94450757 | 123: AY739975 | gi:60266039 |
| 4: EF175566 | gi:143351300 | 64: DQ345768 | gi:85541345 | 124: AY739974 | gi:60266037 |
| 5: EF488048 | gi:143024145 | 65: DQ345767 | gi:85541343 | 125: AY739973 | gi:60266035 |
| 6: EF484033 | gi:140453701 | 66: DQ405288 | gi:90903226 | 126: AY739972 | gi:60266033 |
| 7: EF484031 | gi:140453646 | 67: DQ405287 | gi:90903224 | 127: AY739971 | gi:60266031 |
| 8: EF471930 | gi:134268986 | 68: DQ405286 | gi:90903222 | 128: AY739970 | gi:60266029 |
| 9: EF471929 | gi:134268980 | 69: DQ405285 | gi:90903220 | 129: AY739969 | gi:60266027 |
| 10: EF471928 | gi:134268974 | 70: DQ405284 | gi:90903218 | 130: AY739968 | gi:60266025 |
| 11: EF471927 | gi:134268966 | 71: DQ405283 | gi:90903216 | 131: AY739967 | gi:60266023 |
| 12: EF429118 | gi:130916757 | 72: DQ405282 | gi:90903214 | 132: AY739966 | gi:60266021 |
| 13: EF429117 | gi:130916734 | 73: DQ405281 | gi:90903212 | 133: AY739965 | gi:60266019 |
| 14: EF429116 | gi:130916707 | 74: DQ405280 | gi:90903210 | 134: AY739964 | gi:60266017 |
| 15: EF429115 | gi:130916685 | 75: DQ405279 | gi:90903208 | 135: AY739963 | gi:60266015 |
| 16: EF429114 | gi:130916661 | 76: DQ405278 | gi:90903206 | 136: AY739962 | gi:60266013 |
| 17: EF429113 | gi:130916641 | 77: DQ405277 | gi:90903204 | 137: AY739961 | gi:60266011 |
| 18: EF429112 | gi:130916613 | 78: DQ864705 | gi:112821997 | 138: AY739960 | gi:60266009 |
| 19: EF429111 | gi:130916593 | 79: DQ064788 | gi:67633230 | 139: AY739959 | gi:60266007 |
| 20: EF429110 | gi:130916565 | 80: DQ064787 | gi:67633228 | 140: AY739958 | gi:60266005 |
| 21: EF429109 | gi:130916537 | 81: DQ642048 | gi:110559165 | 141: AY749428 | gi:58618023 |
| 22: EF429108 | gi:130916517 | 82: AH015834 | gi:110559163 | 142: AY749427 | gi:58618021 |
| 23: EF429107 | gi:130916494 | 83: DQ176021 | gi:78064577 | 143: AY749426 | gi:58618019 |
| 24: EF429106 | gi:130916479 | 84: DQ176020 | gi:78064568 | 144: AY749425 | gi:58618017 |
| 25: EF429105 | gi:130916455 | 85: DQ176019 | gi:78064559 | 145: AY749424 | gi:58618015 |
| 26: EF429104 | gi:130916423 | 86: AY740012 | gi:60266113 | 146: AY749423 | gi:58618013 |
| 27: EF429103 | gi:130916392 | 87: AY740011 | gi:60266111 | 147: AY749422 | gi:58618011 |
| 28: EF429102 | gi:130916366 | 88: AY740010 | gi:60266109 | 148: AY749421 | gi:58618009 |
| 29: EF429101 | gi:130916342 | 89: AY740009 | gi:60266107 | 149: AY749420 | gi:58618007 |
| 30: EF429100 | gi:130916315 | 90: AY740008 | gi:60266105 | 150: AY749419 | gi:58618005 |
| 31: EF429099 | gi:130916285 | 91: AY740007 | gi:60266103 | 151: AY749418 | gi:58618003 |
| 32: EF398053 | gi:126143288 | 92: AY740006 | gi:60266101 | 152: AY749417 | gi:58618001 |
| 33: EF398052 | gi:126143286 | 93: AY740005 | gi:60266099 | 153: AY743937 | gi:58532753 |
| 34: EF398051 | gi:126143284 | 94: AY740004 | gi:60266097 | 154: AY743936 | gi:58532751 |

FIG. 6 (con't)

| | | | | | | | | |
|---|---|---|---|---|---|---|---|---|
| 35: | EF398050 | gi:126143282 | 95: | AY740003 | gi:60266095 | 155: | AY743935 | gi:58532749 |
| 36: | EF398049 | gi:126143280 | 96: | AY740002 | gi:60266093 | 156: | AY743934 | gi:58532747 |
| 37: | EF398048 | gi:126143278 | 97: | AY740001 | gi:60266091 | 157: | AY743933 | gi:58532745 |
| 38: | EF398047 | gi:126143276 | 98: | AY740000 | gi:60266089 | 158: | AY743932 | gi:58532743 |
| 39: | EF398046 | gi:126143274 | 99: | AY739999 | gi:60266087 | 159: | AY743931 | gi:58532741 |
| 40: | NC_001961 | gi:9630807 | 100: | AY739998 | gi:60266085 | 160: | AY730551 | gi:57902446 |
| 41: | EF153486 | gi:119721016 | 101: | AY739997 | gi:60266083 | 161: | DQ494316 | gi:94323339 |
| 42: | EF153485 | gi:119721014 | 102: | AY739996 | gi:60266081 | 162: | DQ494315 | gi:94323337 |
| 43: | EF150362 | gi:119655539 | 103: | AY739995 | gi:60266079 | 163: | DQ494314 | gi:94323335 |
| 44: | EF150361 | gi:119655536 | 104: | AY739994 | gi:60266077 | 164: | DQ494313 | gi:94323333 |
| 45: | DQ120518 | gi:71152866 | 105: | AY739993 | gi:60266075 | 165: | DQ494312 | gi:94323331 |
| 46: | AY450301 | gi:51973630 | 106: | AY739992 | gi:60266073 | 166: | DQ494311 | gi:94323329 |
| 47: | EF112447 | gi:119068053 | 107: | AY739991 | gi:60266071 | 167: | DQ494310 | gi:94323327 |
| 48: | EF112446 | gi:119068027 | 108: | AY739990 | gi:60266069 | 168: | DQ494309 | gi:94323325 |
| 49: | EF112445 | gi:119068009 | 109: | AY739989 | gi:60266067 | 169: | DQ494308 | gi:94323323 |
| 50: | EF104601 | gi:118505055 | 110: | AY739988 | gi:60266065 | 170: | DQ494307 | gi:94323321 |
| 51: | EF104600 | gi:118505053 | 111: | AY739987 | gi:60266063 | 171: | DQ494306 | gi:94323319 |
| 52: | DQ779791 | gi:110588840 | 112: | AY739986 | gi:60266061 | 172: | DQ494305 | gi:94323317 |
| 53: | EF075945 | gi:118140107 | 113: | AY739985 | gi:60266059 | 173: | DQ494304 | gi:94323315 |
| 54: | DQ489311 | gi:99082872 | 114: | AY739984 | gi:60266057 | 174: | DQ494303 | gi:94323313 |
| 55: | DQ306879 | gi:83588789 | 115: | AY739983 | gi:60266055 | 175: | DQ494302 | gi:94323311 |
| 56: | DQ306878 | gi:83588787 | 116: | AY739982 | gi:60266053 | 176: | DQ494301 | gi:94323309 |
| 57: | DQ306877 | gi:83588785 | 117: | AY739981 | gi:60266051 | 177: | DQ494300 | gi:94323307 |
| 58: | EF014225 | gi:116664766 | 118: | AY739980 | gi:60266049 | 178: | DQ494299 | gi:94323305 |
| 59: | DQ988080 | gi:116006721 | 119: | AY739979 | gi:60266047 | 179: | DQ494298 | gi:94323303 |
| 60: | CS421737 | gi:115409850 | 120: | AY739978 | gi:60266045 | 180: | DQ494297 | gi:94323301 |

| Accession No. | | GI No. | Accession No. | | GI No. | Accession No. | | GI No. |
|---|---|---|---|---|---|---|---|---|
| 181: | DQ494296 | gi:94323299 | 241: | DQ478386 | gi:91992114 | 301: | DQ478326 | gi:91991994 |
| 182: | DQ494295 | gi:94323297 | 242: | DQ478385 | gi:91992112 | 302: | DQ478325 | gi:91991992 |
| 183: | DQ494294 | gi:94323295 | 243: | DQ478384 | gi:91992110 | 303: | DQ478324 | gi:91991990 |
| 184: | DQ494293 | gi:94323293 | 244: | DQ478383 | gi:91992108 | 304: | DQ478323 | gi:91991988 |
| 185: | DQ494292 | gi:94323291 | 245: | DQ478382 | gi:91992106 | 305: | DQ478322 | gi:91991986 |
| 186: | DQ494291 | gi:94323289 | 246: | DQ478381 | gi:91992104 | 306: | DQ478321 | gi:91991984 |
| 187: | DQ494290 | gi:94323287 | 247: | DQ478380 | gi:91992102 | 307: | DQ478320 | gi:91991982 |
| 188: | DQ494289 | gi:94323285 | 248: | DQ478379 | gi:91992100 | 308: | DQ478319 | gi:91991980 |
| 189: | DQ494288 | gi:94323283 | 249: | DQ478378 | gi:91992098 | 309: | DQ478318 | gi:91991978 |
| 190: | DQ494287 | gi:94323281 | 250: | DQ478377 | gi:91992096 | 310: | DQ478317 | gi:91991976 |

FIG. 6 (con't)

| | | | | | | | | |
|---|---|---|---|---|---|---|---|---|
| 191: | DQ494286 | gi:94323279 | 251: | DQ478376 | gi:91992094 | 311: | DQ478316 | gi:91991974 |
| 192: | DQ494285 | gi:94323277 | 252: | DQ478375 | gi:91992092 | 312: | DQ478315 | gi:91991972 |
| 193: | DQ494284 | gi:94323275 | 253: | DQ478374 | gi:91992090 | 313: | DQ478314 | gi:91991970 |
| 194: | DQ494283 | gi:94323273 | 254: | DQ478373 | gi:91992088 | 314: | DQ478313 | gi:91991968 |
| 195: | DQ494282 | gi:94323271 | 255: | DQ478372 | gi:91992086 | 315: | DQ478312 | gi:91991966 |
| 196: | DQ494281 | gi:94323269 | 256: | DQ478371 | gi:91992084 | 316: | DQ478311 | gi:91991964 |
| 197: | DQ494280 | gi:94323267 | 257: | DQ478370 | gi:91992082 | 317: | DQ478310 | gi:91991962 |
| 198: | DQ494279 | gi:94323265 | 258: | DQ478369 | gi:91992080 | 318: | DQ478309 | gi:91991960 |
| 199: | DQ494278 | gi:94323263 | 259: | DQ478368 | gi:91992078 | 319: | DQ478308 | gi:91991958 |
| 200: | DQ494277 | gi:94323261 | 260: | DQ478367 | gi:91992076 | 320: | DQ478307 | gi:91991956 |
| 201: | DQ494276 | gi:94323259 | 261: | DQ478366 | gi:91992074 | 321: | DQ478306 | gi:91991954 |
| 202: | DQ494275 | gi:94323257 | 262: | DQ478365 | gi:91992072 | 322: | DQ478305 | gi:91991952 |
| 203: | DQ494274 | gi:94323255 | 263: | DQ478364 | gi:91992070 | 323: | DQ478304 | gi:91991950 |
| 204: | DQ494273 | gi:94323253 | 264: | DQ478363 | gi:91992068 | 324: | DQ478303 | gi:91991948 |
| 205: | DQ494272 | gi:94323251 | 265: | DQ478362 | gi:91992066 | 325: | DQ478302 | gi:91991946 |
| 206: | DQ494271 | gi:94323249 | 266: | DQ478361 | gi:91992064 | 326: | DQ478301 | gi:91991944 |
| 207: | DQ494270 | gi:94323247 | 267: | DQ478360 | gi:91992062 | 327: | DQ478300 | gi:91991942 |
| 208: | DQ494269 | gi:94323245 | 268: | DQ478359 | gi:91992060 | 328: | DQ478299 | gi:91991940 |
| 209: | DQ494268 | gi:94323243 | 269: | DQ478358 | gi:91992058 | 329: | DQ478298 | gi:91991938 |
| 210: | DQ494267 | gi:94323241 | 270: | DQ478357 | gi:91992056 | 330: | DQ478297 | gi:91991936 |
| 211: | DQ494266 | gi:94323239 | 271: | DQ478356 | gi:91992054 | 331: | DQ478296 | gi:91991934 |
| 212: | DQ494265 | gi:94323237 | 272: | DQ478355 | gi:91992052 | 332: | DQ478295 | gi:91991932 |
| 213: | DQ494264 | gi:94323235 | 273: | DQ478354 | gi:91992050 | 333: | DQ478294 | gi:91991930 |
| 214: | DQ494263 | gi:94323233 | 274: | DQ478353 | gi:91992048 | 334: | DQ478293 | gi:91991928 |
| 215: | DQ494262 | gi:94323231 | 275: | DQ478352 | gi:91992046 | 335: | DQ478292 | gi:91991926 |
| 216: | DQ494261 | gi:94323229 | 276: | DQ478351 | gi:91992044 | 336: | DQ478291 | gi:91991924 |
| 217: | DQ494260 | gi:94323227 | 277: | DQ478350 | gi:91992042 | 337: | DQ478290 | gi:91991922 |
| 218: | DQ494259 | gi:94323225 | 278: | DQ478349 | gi:91992040 | 338: | DQ478289 | gi:91991920 |
| 219: | DQ494258 | gi:94323223 | 279: | DQ478348 | gi:91992038 | 339: | DQ478288 | gi:91991918 |
| 220: | DQ494257 | gi:94323221 | 280: | DQ478347 | gi:91992036 | 340: | DQ478287 | gi:91991916 |
| 221: | DQ494256 | gi:94323219 | 281: | DQ478346 | gi:91992034 | 341: | DQ478286 | gi:91991914 |
| 222: | DQ494255 | gi:94323217 | 282: | DQ478345 | gi:91992032 | 342: | DQ478285 | gi:91991912 |
| 223: | DQ494254 | gi:94323215 | 283: | DQ478344 | gi:91992030 | 343: | DQ478284 | gi:91991910 |
| 224: | DQ478403 | gi:91992148 | 284: | DQ478343 | gi:91992028 | 344: | DQ478283 | gi:91991908 |
| 225: | DQ478402 | gi:91992146 | 285: | DQ478342 | gi:91992026 | 345: | DQ478282 | gi:91991906 |
| 226: | DQ478401 | gi:91992144 | 286: | DQ478341 | gi:91992024 | 346: | DQ478281 | gi:91991904 |
| 227: | DQ478400 | gi:91992142 | 287: | DQ478340 | gi:91992022 | 347: | DQ478280 | gi:91991902 |
| 228: | DQ478399 | gi:91992140 | 288: | DQ478339 | gi:91992020 | 348: | DQ478279 | gi:91991900 |

FIG. 6 (con't)

| | | | | | | | | |
|---|---|---|---|---|---|---|---|---|
| 229: | DQ478398 | gi:91992138 | 289: | DQ478338 | gi:91992018 | 349: | DQ478278 | gi:91991898 |
| 230: | DQ478397 | gi:91992136 | 290: | DQ478337 | gi:91992016 | 350: | DQ478277 | gi:91991896 |
| 231: | DQ478396 | gi:91992134 | 291: | DQ478336 | gi:91992014 | 351: | DQ478276 | gi:91991894 |
| 232: | DQ478395 | gi:91992132 | 292: | DQ478335 | gi:91992012 | 352: | DQ478275 | gi:91991892 |
| 233: | DQ478394 | gi:91992130 | 293: | DQ478334 | gi:91992010 | 353: | DQ478274 | gi:91991890 |
| 234: | DQ478393 | gi:91992128 | 294: | DQ478333 | gi:91992008 | 354: | DQ478273 | gi:91991888 |
| 235: | DQ478392 | gi:91992126 | 295: | DQ478332 | gi:91992006 | 355: | DQ478272 | gi:91991886 |
| 236: | DQ478391 | gi:91992124 | 296: | DQ478331 | gi:91992004 | 356: | DQ478271 | gi:91991884 |
| 237: | DQ478390 | gi:91992122 | 297: | DQ478330 | gi:91992002 | 357: | DQ478270 | gi:91991882 |
| 238: | DQ478389 | gi:91992120 | 298: | DQ478329 | gi:91992000 | 358: | DQ478269 | gi:91991880 |
| 239: | DQ478388 | gi:91992118 | 299: | DQ478328 | gi:91991998 | 359: | DQ478268 | gi:91991878 |
| 240: | DQ478387 | gi:91992116 | 300: | DQ478327 | gi:91991996 | 360: | DQ478267 | gi:91991876 |

| Accession No. | | GI No. | Accession No. | | GI No. | Accession No. | | GI No. |
|---|---|---|---|---|---|---|---|---|
| 361: | DQ478266 | gi:91991874 | 421: | DQ478206 | gi:91991754 | 481: | DQ478146 | gi:91991634 |
| 362: | DQ478265 | gi:91991872 | 422: | DQ478205 | gi:91991752 | 482: | DQ478145 | gi:91991632 |
| 363: | DQ478264 | gi:91991870 | 423: | DQ478204 | gi:91991750 | 483: | DQ478144 | gi:91991630 |
| 364: | DQ478263 | gi:91991868 | 424: | DQ478203 | gi:91991748 | 484: | DQ478143 | gi:91991628 |
| 365: | DQ478262 | gi:91991866 | 425: | DQ478202 | gi:91991746 | 485: | DQ478142 | gi:91991626 |
| 366: | DQ478261 | gi:91991864 | 426: | DQ478201 | gi:91991744 | 486: | DQ478141 | gi:91991624 |
| 367: | DQ478260 | gi:91991862 | 427: | DQ478200 | gi:91991742 | 487: | DQ478140 | gi:91991622 |
| 368: | DQ478259 | gi:91991860 | 428: | DQ478199 | gi:91991740 | 488: | DQ478139 | gi:91991620 |
| 369: | DQ478258 | gi:91991858 | 429: | DQ478198 | gi:91991738 | 489: | DQ478138 | gi:91991618 |
| 370: | DQ478257 | gi:91991856 | 430: | DQ478197 | gi:91991736 | 490: | DQ478137 | gi:91991616 |
| 371: | DQ478256 | gi:91991854 | 431: | DQ478196 | gi:91991734 | 491: | DQ478136 | gi:91991614 |
| 372: | DQ478255 | gi:91991852 | 432: | DQ478195 | gi:91991732 | 492: | DQ478135 | gi:91991612 |
| 373: | DQ478254 | gi:91991850 | 433: | DQ478194 | gi:91991730 | 493: | DQ478134 | gi:91991610 |
| 374: | DQ478253 | gi:91991848 | 434: | DQ478193 | gi:91991728 | 494: | DQ478133 | gi:91991608 |
| 375: | DQ478252 | gi:91991846 | 435: | DQ478192 | gi:91991726 | 495: | DQ478132 | gi:91991606 |
| 376: | DQ478251 | gi:91991844 | 436: | DQ478191 | gi:91991724 | 496: | DQ478131 | gi:91991604 |
| 377: | DQ478250 | gi:91991842 | 437: | DQ478190 | gi:91991722 | 497: | DQ478130 | gi:91991602 |
| 378: | DQ478249 | gi:91991840 | 438: | DQ478189 | gi:91991720 | 498: | DQ478129 | gi:91991600 |
| 379: | DQ478248 | gi:91991838 | 439: | DQ478188 | gi:91991718 | 499: | DQ478128 | gi:91991598 |
| 380: | DQ478247 | gi:91991836 | 440: | DQ478187 | gi:91991716 | 500: | DQ478127 | gi:91991596 |
| 381: | DQ478246 | gi:91991834 | 441: | DQ478186 | gi:91991714 | 501: | DQ478126 | gi:91991594 |
| 382: | DQ478245 | gi:91991832 | 442: | DQ478185 | gi:91991712 | 502: | DQ478125 | gi:91991592 |
| 383: | DQ478244 | gi:91991830 | 443: | DQ478184 | gi:91991710 | 503: | DQ478124 | gi:91991590 |
| 384: | DQ478243 | gi:91991828 | 444: | DQ478183 | gi:91991708 | 504: | DQ478123 | gi:91991588 |

FIG. 6 (con't)

| | Accession No. | GI No. | | Accession No. | GI No. | | Accession No. | GI No. |
|---|---|---|---|---|---|---|---|---|
| 385: | DQ478242 | gi:91991826 | 445: | DQ478182 | gi:91991706 | 505: | DQ478122 | gi:91991586 |
| 386: | DQ478241 | gi:91991824 | 446: | DQ478181 | gi:91991704 | 506: | DQ478121 | gi:91991584 |
| 387: | DQ478240 | gi:91991822 | 447: | DQ478180 | gi:91991702 | 507: | DQ478120 | gi:91991582 |
| 388: | DQ478239 | gi:91991820 | 448: | DQ478179 | gi:91991700 | 508: | DQ478119 | gi:91991580 |
| 389: | DQ478238 | gi:91991818 | 449: | DQ478178 | gi:91991698 | 509: | DQ478118 | gi:91991578 |
| 390: | DQ478237 | gi:91991816 | 450: | DQ478177 | gi:91991696 | 510: | DQ478117 | gi:91991576 |
| 391: | DQ478236 | gi:91991814 | 451: | DQ478176 | gi:91991694 | 511: | DQ478116 | gi:91991574 |
| 392: | DQ478235 | gi:91991812 | 452: | DQ478175 | gi:91991692 | 512: | DQ478115 | gi:91991572 |
| 393: | DQ478234 | gi:91991810 | 453: | DQ478174 | gi:91991690 | 513: | DQ478114 | gi:91991570 |
| 394: | DQ478233 | gi:91991808 | 454: | DQ478173 | gi:91991688 | 514: | DQ478113 | gi:91991568 |
| 395: | DQ478232 | gi:91991806 | 455: | DQ478172 | gi:91991686 | 515: | DQ478112 | gi:91991566 |
| 396: | DQ478231 | gi:91991804 | 456: | DQ478171 | gi:91991684 | 516: | DQ478111 | gi:91991564 |
| 397: | DQ478230 | gi:91991802 | 457: | DQ478170 | gi:91991682 | 517: | DQ478110 | gi:91991562 |
| 398: | DQ478229 | gi:91991800 | 458: | DQ478169 | gi:91991680 | 518: | DQ478109 | gi:91991560 |
| 399: | DQ478228 | gi:91991798 | 459: | DQ478168 | gi:91991678 | 519: | DQ478108 | gi:91991558 |
| 400: | DQ478227 | gi:91991796 | 460: | DQ478167 | gi:91991676 | 520: | DQ478107 | gi:91991556 |
| 401: | DQ478226 | gi:91991794 | 461: | DQ478166 | gi:91991674 | 521: | DQ478106 | gi:91991554 |
| 402: | DQ478225 | gi:91991792 | 462: | DQ478165 | gi:91991672 | 522: | DQ478105 | gi:91991552 |
| 403: | DQ478224 | gi:91991790 | 463: | DQ478164 | gi:91991670 | 523: | DQ478104 | gi:91991550 |
| 404: | DQ478223 | gi:91991788 | 464: | DQ478163 | gi:91991668 | 524: | DQ478103 | gi:91991548 |
| 405: | DQ478222 | gi:91991786 | 465: | DQ478162 | gi:91991666 | 525: | DQ478102 | gi:91991546 |
| 406: | DQ478221 | gi:91991784 | 466: | DQ478161 | gi:91991664 | 526: | DQ478101 | gi:91991544 |
| 407: | DQ478220 | gi:91991782 | 467: | DQ478160 | gi:91991662 | 527: | DQ478100 | gi:91991542 |
| 408: | DQ478219 | gi:91991780 | 468: | DQ478159 | gi:91991660 | 528: | DQ478099 | gi:91991540 |
| 409: | DQ478218 | gi:91991778 | 469: | DQ478158 | gi:91991658 | 529: | DQ478098 | gi:91991538 |
| 410: | DQ478217 | gi:91991776 | 470: | DQ478157 | gi:91991656 | 530: | DQ478097 | gi:91991536 |
| 411: | DQ478216 | gi:91991774 | 471: | DQ478156 | gi:91991654 | 531: | DQ478096 | gi:91991534 |
| 412: | DQ478215 | gi:91991772 | 472: | DQ478155 | gi:91991652 | 532: | DQ478095 | gi:91991532 |
| 413: | DQ478214 | gi:91991770 | 473: | DQ478154 | gi:91991650 | 533: | DQ478094 | gi:91991530 |
| 414: | DQ478213 | gi:91991768 | 474: | DQ478153 | gi:91991648 | 534: | DQ478093 | gi:91991528 |
| 415: | DQ478212 | gi:91991766 | 475: | DQ478152 | gi:91991646 | 535: | DQ478092 | gi:91991526 |
| 416: | DQ478211 | gi:91991764 | 476: | DQ478151 | gi:91991644 | 536: | DQ478091 | gi:91991524 |
| 417: | DQ478210 | gi:91991762 | 477: | DQ478150 | gi:91991642 | 537: | DQ478090 | gi:91991522 |
| 418: | DQ478209 | gi:91991760 | 478: | DQ478149 | gi:91991640 | 538: | DQ478089 | gi:91991520 |
| 419: | DQ478208 | gi:91991758 | 479: | DQ478148 | gi:91991638 | 539: | DQ478088 | gi:91991518 |
| 420: | DQ478207 | gi:91991756 | 480: | DQ478147 | gi:91991636 | 540: | DQ478087 | gi:91991516 |

FIG. 6 (con't)

| | | | | | | | | |
|---|---|---|---|---|---|---|---|---|
| 541: | DQ478086 | gi:91991514 | 601: | DQ478026 | gi:91991394 | 661: | DQ477966 | gi:91991274 |
| 542: | DQ478085 | gi:91991512 | 602: | DQ478025 | gi:91991392 | 662: | DQ477965 | gi:91991272 |
| 543: | DQ478084 | gi:91991510 | 603: | DQ478024 | gi:91991390 | 663: | DQ477964 | gi:91991270 |
| 544: | DQ478083 | gi:91991508 | 604: | DQ478023 | gi:91991388 | 664: | DQ477963 | gi:91991268 |
| 545: | DQ478082 | gi:91991506 | 605: | DQ478022 | gi:91991386 | 665: | DQ477962 | gi:91991266 |
| 546: | DQ478081 | gi:91991504 | 606: | DQ478021 | gi:91991384 | 666: | DQ477961 | gi:91991264 |
| 547: | DQ478080 | gi:91991502 | 607: | DQ478020 | gi:91991382 | 667: | DQ477960 | gi:91991262 |
| 548: | DQ478079 | gi:91991500 | 608: | DQ478019 | gi:91991380 | 668: | DQ477959 | gi:91991260 |
| 549: | DQ478078 | gi:91991498 | 609: | DQ478018 | gi:91991378 | 669: | DQ477958 | gi:91991258 |
| 550: | DQ478077 | gi:91991496 | 610: | DQ478017 | gi:91991376 | 670: | DQ477957 | gi:91991256 |
| 551: | DQ478076 | gi:91991494 | 611: | DQ478016 | gi:91991374 | 671: | DQ477956 | gi:91991254 |
| 552: | DQ478075 | gi:91991492 | 612: | DQ478015 | gi:91991372 | 672: | DQ477955 | gi:91991252 |
| 553: | DQ478074 | gi:91991490 | 613: | DQ478014 | gi:91991370 | 673: | DQ477954 | gi:91991250 |
| 554: | DQ478073 | gi:91991488 | 614: | DQ478013 | gi:91991368 | 674: | DQ477953 | gi:91991248 |
| 555: | DQ478072 | gi:91991486 | 615: | DQ478012 | gi:91991366 | 675: | DQ477952 | gi:91991246 |
| 556: | DQ478071 | gi:91991484 | 616: | DQ478011 | gi:91991364 | 676: | DQ477951 | gi:91991244 |
| 557: | DQ478070 | gi:91991482 | 617: | DQ478010 | gi:91991362 | 677: | DQ477950 | gi:91991242 |
| 558: | DQ478069 | gi:91991480 | 618: | DQ478009 | gi:91991360 | 678: | DQ477949 | gi:91991240 |
| 559: | DQ478068 | gi:91991478 | 619: | DQ478008 | gi:91991358 | 679: | DQ477948 | gi:91991238 |
| 560: | DQ478067 | gi:91991476 | 620: | DQ478007 | gi:91991356 | 680: | DQ477947 | gi:91991236 |
| 561: | DQ478066 | gi:91991474 | 621: | DQ478006 | gi:91991354 | 681: | DQ477946 | gi:91991234 |
| 562: | DQ478065 | gi:91991472 | 622: | DQ478005 | gi:91991352 | 682: | DQ477945 | gi:91991232 |
| 563: | DQ478064 | gi:91991470 | 623: | DQ478004 | gi:91991350 | 683: | DQ477944 | gi:91991230 |
| 564: | DQ478063 | gi:91991468 | 624: | DQ478003 | gi:91991348 | 684: | DQ477943 | gi:91991228 |
| 565: | DQ478062 | gi:91991466 | 625: | DQ478002 | gi:91991346 | 685: | DQ477942 | gi:91991226 |
| 566: | DQ478061 | gi:91991464 | 626: | DQ478001 | gi:91991344 | 686: | DQ477941 | gi:91991224 |
| 567: | DQ478060 | gi:91991462 | 627: | DQ478000 | gi:91991342 | 687: | DQ477940 | gi:91991222 |
| 568: | DQ478059 | gi:91991460 | 628: | DQ477999 | gi:91991340 | 688: | DQ477939 | gi:91991220 |
| 569: | DQ478058 | gi:91991458 | 629: | DQ477998 | gi:91991338 | 689: | DQ477938 | gi:91991218 |
| 570: | DQ478057 | gi:91991456 | 630: | DQ477997 | gi:91991336 | 690: | DQ477937 | gi:91991216 |
| 571: | DQ478056 | gi:91991454 | 631: | DQ477996 | gi:91991334 | 691: | DQ477936 | gi:91991214 |
| 572: | DQ478055 | gi:91991452 | 632: | DQ477995 | gi:91991332 | 692: | DQ477935 | gi:91991212 |
| 573: | DQ478054 | gi:91991450 | 633: | DQ477994 | gi:91991330 | 693: | DQ477934 | gi:91991210 |
| 574: | DQ478053 | gi:91991448 | 634: | DQ477993 | gi:91991328 | 694: | DQ477933 | gi:91991208 |
| 575: | DQ478052 | gi:91991446 | 635: | DQ477992 | gi:91991326 | 695: | DQ477932 | gi:91991206 |
| 576: | DQ478051 | gi:91991444 | 636: | DQ477991 | gi:91991324 | 696: | DQ477931 | gi:91991204 |
| 577: | DQ478050 | gi:91991442 | 637: | DQ477990 | gi:91991322 | 697: | DQ477930 | gi:91991202 |
| 578: | DQ478049 | gi:91991440 | 638: | DQ477989 | gi:91991320 | 698: | DQ477929 | gi:91991200 |

FIG. 6 (con't)

| | | | | | | | | |
|---|---|---|---|---|---|---|---|---|
| 579: | DQ478048 | gi:91991438 | 639: | DQ477988 | gi:91991318 | 699: | DQ477928 | gi:91991198 |
| 580: | DQ478047 | gi:91991436 | 640: | DQ477987 | gi:91991316 | 700: | DQ477927 | gi:91991196 |
| 581: | DQ478046 | gi:91991434 | 641: | DQ477986 | gi:91991314 | 701: | DQ477926 | gi:91991194 |
| 582: | DQ478045 | gi:91991432 | 642: | DQ477985 | gi:91991312 | 702: | DQ477925 | gi:91991192 |
| 583: | DQ478044 | gi:91991430 | 643: | DQ477984 | gi:91991310 | 703: | DQ477924 | gi:91991190 |
| 584: | DQ478043 | gi:91991428 | 644: | DQ477983 | gi:91991308 | 704: | DQ477923 | gi:91991188 |
| 585: | DQ478042 | gi:91991426 | 645: | DQ477982 | gi:91991306 | 705: | DQ477922 | gi:91991186 |
| 586: | DQ478041 | gi:91991424 | 646: | DQ477981 | gi:91991304 | 706: | DQ477921 | gi:91991184 |
| 587: | DQ478040 | gi:91991422 | 647: | DQ477980 | gi:91991302 | 707: | DQ477920 | gi:91991182 |
| 588: | DQ478039 | gi:91991420 | 648: | DQ477979 | gi:91991300 | 708: | DQ477919 | gi:91991180 |
| 589: | DQ478038 | gi:91991418 | 649: | DQ477978 | gi:91991298 | 709: | DQ477918 | gi:91991178 |
| 590: | DQ478037 | gi:91991416 | 650: | DQ477977 | gi:91991296 | 710: | DQ477917 | gi:91991176 |
| 591: | DQ478036 | gi:91991414 | 651: | DQ477976 | gi:91991294 | 711: | DQ477916 | gi:91991174 |
| 592: | DQ478035 | gi:91991412 | 652: | DQ477975 | gi:91991292 | 712: | DQ477915 | gi:91991172 |
| 593: | DQ478034 | gi:91991410 | 653: | DQ477974 | gi:91991290 | 713: | DQ477914 | gi:91991170 |
| 594: | DQ478033 | gi:91991408 | 654: | DQ477973 | gi:91991288 | 714: | DQ477913 | gi:91991168 |
| 595: | DQ478032 | gi:91991406 | 655: | DQ477972 | gi:91991286 | 715: | DQ477912 | gi:91991166 |
| 596: | DQ478031 | gi:91991404 | 656: | DQ477971 | gi:91991284 | 716: | DQ477911 | gi:91991164 |
| 597: | DQ478030 | gi:91991402 | 657: | DQ477970 | gi:91991282 | 717: | DQ477910 | gi:91991162 |
| 598: | DQ478029 | gi:91991400 | 658: | DQ477969 | gi:91991280 | 718: | DQ477909 | gi:91991160 |
| 599: | DQ478028 | gi:91991398 | 659: | DQ477968 | gi:91991278 | 719: | DQ477908 | gi:91991158 |
| 600: | DQ478027 | gi:91991396 | 660: | DQ477967 | gi:91991276 | 720: | DQ477907 | gi:91991156 |

| Accession No. | | GI No. | Accession No. | | GI No. | Accession No. | | GI No. |
|---|---|---|---|---|---|---|---|---|
| 721: | DQ477906 | gi:91991154 | 781: | DQ477846 | gi:91991034 | 841: | DQ477786 | gi:91990914 |
| 722: | DQ477905 | gi:91991152 | 782: | DQ477845 | gi:91991032 | 842: | DQ477785 | gi:91990912 |
| 723: | DQ477904 | gi:91991150 | 783: | DQ477844 | gi:91991030 | 843: | DQ477784 | gi:91990910 |
| 724: | DQ477903 | gi:91991148 | 784: | DQ477843 | gi:91991028 | 844: | DQ477783 | gi:91990908 |
| 725: | DQ477902 | gi:91991146 | 785: | DQ477842 | gi:91991026 | 845: | DQ477782 | gi:91990906 |
| 726: | DQ477901 | gi:91991144 | 786: | DQ477841 | gi:91991024 | 846: | DQ477781 | gi:91990904 |
| 727: | DQ477900 | gi:91991142 | 787: | DQ477840 | gi:91991022 | 847: | DQ477780 | gi:91990902 |
| 728: | DQ477899 | gi:91991140 | 788: | DQ477839 | gi:91991020 | 848: | DQ477779 | gi:91990900 |
| 729: | DQ477898 | gi:91991138 | 789: | DQ477838 | gi:91991018 | 849: | DQ477778 | gi:91990898 |
| 730: | DQ477897 | gi:91991136 | 790: | DQ477837 | gi:91991016 | 850: | DQ477777 | gi:91990896 |
| 731: | DQ477896 | gi:91991134 | 791: | DQ477836 | gi:91991014 | 851: | DQ477776 | gi:91990894 |
| 732: | DQ477895 | gi:91991132 | 792: | DQ477835 | gi:91991012 | 852: | DQ477775 | gi:91990892 |
| 733: | DQ477894 | gi:91991130 | 793: | DQ477834 | gi:91991010 | 853: | DQ477774 | gi:91990890 |
| 734: | DQ477893 | gi:91991128 | 794: | DQ477833 | gi:91991008 | 854: | DQ477773 | gi:91990888 |

FIG. 6 (con't)

| | | | | | | | | |
|---|---|---|---|---|---|---|---|---|
| 735: | DQ477892 | gi:91991126 | 795: | DQ477832 | gi:91991006 | 855: | DQ477772 | gi:91990886 |
| 736: | DQ477891 | gi:91991124 | 796: | DQ477831 | gi:91991004 | 856: | DQ477771 | gi:91990884 |
| 737: | DQ477890 | gi:91991122 | 797: | DQ477830 | gi:91991002 | 857: | DQ477770 | gi:91990882 |
| 738: | DQ477889 | gi:91991120 | 798: | DQ477829 | gi:91991000 | 858: | DQ477769 | gi:91990880 |
| 739: | DQ477888 | gi:91991118 | 799: | DQ477828 | gi:91990998 | 859: | DQ477768 | gi:91990878 |
| 740: | DQ477887 | gi:91991116 | 800: | DQ477827 | gi:91990996 | 860: | DQ477767 | gi:91990876 |
| 741: | DQ477886 | gi:91991114 | 801: | DQ477826 | gi:91990994 | 861: | DQ477766 | gi:91990874 |
| 742: | DQ477885 | gi:91991112 | 802: | DQ477825 | gi:91990992 | 862: | DQ477765 | gi:91990872 |
| 743: | DQ477884 | gi:91991110 | 803: | DQ477824 | gi:91990990 | 863: | DQ477764 | gi:91990870 |
| 744: | DQ477883 | gi:91991108 | 804: | DQ477823 | gi:91990988 | 864: | DQ477763 | gi:91990868 |
| 745: | DQ477882 | gi:91991106 | 805: | DQ477822 | gi:91990986 | 865: | DQ477762 | gi:91990866 |
| 746: | DQ477881 | gi:91991104 | 806: | DQ477821 | gi:91990984 | 866: | DQ477761 | gi:91990864 |
| 747: | DQ477880 | gi:91991102 | 807: | DQ477820 | gi:91990982 | 867: | DQ477760 | gi:91990862 |
| 748: | DQ477879 | gi:91991100 | 808: | DQ477819 | gi:91990980 | 868: | DQ477759 | gi:91990860 |
| 749: | DQ477878 | gi:91991098 | 809: | DQ477818 | gi:91990978 | 869: | DQ477758 | gi:91990858 |
| 750: | DQ477877 | gi:91991096 | 810: | DQ477817 | gi:91990976 | 870: | DQ477757 | gi:91990856 |
| 751: | DQ477876 | gi:91991094 | 811: | DQ477816 | gi:91990974 | 871: | DQ477756 | gi:91990854 |
| 752: | DQ477875 | gi:91991092 | 812: | DQ477815 | gi:91990972 | 872: | DQ477755 | gi:91990852 |
| 753: | DQ477874 | gi:91991090 | 813: | DQ477814 | gi:91990970 | 873: | DQ477754 | gi:91990850 |
| 754: | DQ477873 | gi:91991088 | 814: | DQ477813 | gi:91990968 | 874: | DQ477753 | gi:91990848 |
| 755: | DQ477872 | gi:91991086 | 815: | DQ477812 | gi:91990966 | 875: | DQ477752 | gi:91990846 |
| 756: | DQ477871 | gi:91991084 | 816: | DQ477811 | gi:91990964 | 876: | DQ477751 | gi:91990844 |
| 757: | DQ477870 | gi:91991082 | 817: | DQ477810 | gi:91990962 | 877: | DQ477750 | gi:91990842 |
| 758: | DQ477869 | gi:91991080 | 818: | DQ477809 | gi:91990960 | 878: | DQ477749 | gi:91990840 |
| 759: | DQ477868 | gi:91991078 | 819: | DQ477808 | gi:91990958 | 879: | DQ477748 | gi:91990838 |
| 760: | DQ477867 | gi:91991076 | 820: | DQ477807 | gi:91990956 | 880: | DQ477747 | gi:91990836 |
| 761: | DQ477866 | gi:91991074 | 821: | DQ477806 | gi:91990954 | 881: | DQ477746 | gi:91990834 |
| 762: | DQ477865 | gi:91991072 | 822: | DQ477805 | gi:91990952 | 882: | DQ477745 | gi:91990832 |
| 763: | DQ477864 | gi:91991070 | 823: | DQ477804 | gi:91990950 | 883: | DQ477744 | gi:91990830 |
| 764: | DQ477863 | gi:91991068 | 824: | DQ477803 | gi:91990948 | 884: | DQ477743 | gi:91990828 |
| 765: | DQ477862 | gi:91991066 | 825: | DQ477802 | gi:91990946 | 885: | DQ477742 | gi:91990826 |
| 766: | DQ477861 | gi:91991064 | 826: | DQ477801 | gi:91990944 | 886: | DQ477741 | gi:91990824 |
| 767: | DQ477860 | gi:91991062 | 827: | DQ477800 | gi:91990942 | 887: | DQ477740 | gi:91990822 |
| 768: | DQ477859 | gi:91991060 | 828: | DQ477799 | gi:91990940 | 888: | DQ477739 | gi:91990820 |
| 769: | DQ477858 | gi:91991058 | 829: | DQ477798 | gi:91990938 | 889: | DQ477738 | gi:91990818 |
| 770: | DQ477857 | gi:91991056 | 830: | DQ477797 | gi:91990936 | 890: | DQ477737 | gi:91990816 |
| 771: | DQ477856 | gi:91991054 | 831: | DQ477796 | gi:91990934 | 891: | DQ477736 | gi:91990814 |
| 772: | DQ477855 | gi:91991052 | 832: | DQ477795 | gi:91990932 | 892: | DQ477735 | gi:91990812 |

FIG. 6 (con't)

| | | | | | | | | |
|---|---|---|---|---|---|---|---|---|
| 773: | DQ477854 | gi:91991050 | 833: | DQ477794 | gi:91990930 | 893: | DQ477734 | gi:91990810 |
| 774: | DQ477853 | gi:91991048 | 834: | DQ477793 | gi:91990928 | 894: | DQ477733 | gi:91990808 |
| 775: | DQ477852 | gi:91991046 | 835: | DQ477792 | gi:91990926 | 895: | DQ477732 | gi:91990806 |
| 776: | DQ477851 | gi:91991044 | 836: | DQ477791 | gi:91990924 | 896: | DQ477731 | gi:91990804 |
| 777: | DQ477850 | gi:91991042 | 837: | DQ477790 | gi:91990922 | 897: | DQ477730 | gi:91990802 |
| 778: | DQ477849 | gi:91991040 | 838: | DQ477789 | gi:91990920 | 898: | DQ477729 | gi:91990800 |
| 779: | DQ477848 | gi:91991038 | 839: | DQ477788 | gi:91990918 | 899: | DQ477728 | gi:91990798 |
| 780: | DQ477847 | gi:91991036 | 840: | DQ477787 | gi:91990916 | 900: | DQ477727 | gi:91990796 |

| Accession No. | | GI No. | Accession No. | | GI No. | Accession No. | | GI No. |
|---|---|---|---|---|---|---|---|---|
| 901: | DQ477726 | gi:91990794 | 961: | DQ477666 | gi:91990674 | 1021: | DQ477606 | gi:91990554 |
| 902: | DQ477725 | gi:91990792 | 962: | DQ477665 | gi:91990672 | 1022: | DQ477605 | gi:91990552 |
| 903: | DQ477724 | gi:91990790 | 963: | DQ477664 | gi:91990670 | 1023: | DQ477604 | gi:91990550 |
| 904: | DQ477723 | gi:91990788 | 964: | DQ477663 | gi:91990668 | 1024: | DQ477603 | gi:91990548 |
| 905: | DQ477722 | gi:91990786 | 965: | DQ477662 | gi:91990666 | 1025: | DQ477602 | gi:91990546 |
| 906: | DQ477721 | gi:91990784 | 966: | DQ477661 | gi:91990664 | 1026: | DQ477601 | gi:91990544 |
| 907: | DQ477720 | gi:91990782 | 967: | DQ477660 | gi:91990662 | 1027: | DQ477600 | gi:91990542 |
| 908: | DQ477719 | gi:91990780 | 968: | DQ477659 | gi:91990660 | 1028: | DQ477599 | gi:91990540 |
| 909: | DQ477718 | gi:91990778 | 969: | DQ477658 | gi:91990658 | 1029: | DQ477598 | gi:91990538 |
| 910: | DQ477717 | gi:91990776 | 970: | DQ477657 | gi:91990656 | 1030: | DQ477597 | gi:91990536 |
| 911: | DQ477716 | gi:91990774 | 971: | DQ477656 | gi:91990654 | 1031: | DQ477596 | gi:91990534 |
| 912: | DQ477715 | gi:91990772 | 972: | DQ477655 | gi:91990652 | 1032: | DQ477595 | gi:91990532 |
| 913: | DQ477714 | gi:91990770 | 973: | DQ477654 | gi:91990650 | 1033: | DQ477594 | gi:91990530 |
| 914: | DQ477713 | gi:91990768 | 974: | DQ477653 | gi:91990648 | 1034: | DQ477593 | gi:91990528 |
| 915: | DQ477712 | gi:91990766 | 975: | DQ477652 | gi:91990646 | 1035: | DQ477592 | gi:91990526 |
| 916: | DQ477711 | gi:91990764 | 976: | DQ477651 | gi:91990644 | 1036: | DQ477591 | gi:91990524 |
| 917: | DQ477710 | gi:91990762 | 977: | DQ477650 | gi:91990642 | 1037: | DQ477590 | gi:91990522 |
| 918: | DQ477709 | gi:91990760 | 978: | DQ477649 | gi:91990640 | 1038: | DQ477589 | gi:91990520 |
| 919: | DQ477708 | gi:91990758 | 979: | DQ477648 | gi:91990638 | 1039: | DQ477588 | gi:91990518 |
| 920: | DQ477707 | gi:91990756 | 980: | DQ477647 | gi:91990636 | 1040: | DQ477587 | gi:91990516 |
| 921: | DQ477706 | gi:91990754 | 981: | DQ477646 | gi:91990634 | 1041: | DQ477586 | gi:91990514 |
| 922: | DQ477705 | gi:91990752 | 982: | DQ477645 | gi:91990632 | 1042: | DQ477585 | gi:91990512 |
| 923: | DQ477704 | gi:91990750 | 983: | DQ477644 | gi:91990630 | 1043: | DQ477584 | gi:91990510 |
| 924: | DQ477703 | gi:91990748 | 984: | DQ477643 | gi:91990628 | 1044: | DQ477583 | gi:91990508 |
| 925: | DQ477702 | gi:91990746 | 985: | DQ477642 | gi:91990626 | 1045: | DQ477582 | gi:91990506 |
| 926: | DQ477701 | gi:91990744 | 986: | DQ477641 | gi:91990624 | 1046: | DQ477581 | gi:91990504 |
| 927: | DQ477700 | gi:91990742 | 987: | DQ477640 | gi:91990622 | 1047: | DQ477580 | gi:91990502 |
| 928: | DQ477699 | gi:91990740 | 988: | DQ477639 | gi:91990620 | 1048: | DQ477579 | gi:91990500 |

FIG. 6 (con't)

| | | | | | | | | |
|---|---|---|---|---|---|---|---|---|
| 929: | DQ477698 | gi:91990738 | 989: | DQ477638 | gi:91990618 | 1049: | DQ477578 | gi:91990498 |
| 930: | DQ477697 | gi:91990736 | 990: | DQ477637 | gi:91990616 | 1050: | DQ477577 | gi:91990496 |
| 931: | DQ477696 | gi:91990734 | 991: | DQ477636 | gi:91990614 | 1051: | DQ477576 | gi:91990494 |
| 932: | DQ477695 | gi:91990732 | 992: | DQ477635 | gi:91990612 | 1052: | DQ477575 | gi:91990492 |
| 933: | DQ477694 | gi:91990730 | 993: | DQ477634 | gi:91990610 | 1053: | DQ477574 | gi:91990490 |
| 934: | DQ477693 | gi:91990728 | 994: | DQ477633 | gi:91990608 | 1054: | DQ477573 | gi:91990488 |
| 935: | DQ477692 | gi:91990726 | 995: | DQ477632 | gi:91990606 | 1055: | DQ477572 | gi:91990486 |
| 936: | DQ477691 | gi:91990724 | 996: | DQ477631 | gi:91990604 | 1056: | DQ477571 | gi:91990484 |
| 937: | DQ477690 | gi:91990722 | 997: | DQ477630 | gi:91990602 | 1057: | DQ477570 | gi:91990482 |
| 938: | DQ477689 | gi:91990720 | 998: | DQ477629 | gi:91990600 | 1058: | DQ477569 | gi:91990480 |
| 939: | DQ477688 | gi:91990718 | 999: | DQ477628 | gi:91990598 | 1059: | DQ477568 | gi:91990478 |
| 940: | DQ477687 | gi:91990716 | 1000: | DQ477627 | gi:91990596 | 1060: | DQ477567 | gi:91990476 |
| 941: | DQ477686 | gi:91990714 | 1001: | DQ477626 | gi:91990594 | 1061: | DQ477566 | gi:91990474 |
| 942: | DQ477685 | gi:91990712 | 1002: | DQ477625 | gi:91990592 | 1062: | DQ477565 | gi:91990472 |
| 943: | DQ477684 | gi:91990710 | 1003: | DQ477624 | gi:91990590 | 1063: | DQ477564 | gi:91990470 |
| 944: | DQ477683 | gi:91990708 | 1004: | DQ477623 | gi:91990588 | 1064: | DQ477563 | gi:91990468 |
| 945: | DQ477682 | gi:91990706 | 1005: | DQ477622 | gi:91990586 | 1065: | DQ477562 | gi:91990466 |
| 946: | DQ477681 | gi:91990704 | 1006: | DQ477621 | gi:91990584 | 1066: | DQ477561 | gi:91990464 |
| 947: | DQ477680 | gi:91990702 | 1007: | DQ477620 | gi:91990582 | 1067: | DQ477560 | gi:91990462 |
| 948: | DQ477679 | gi:91990700 | 1008: | DQ477619 | gi:91990580 | 1068: | DQ477559 | gi:91990460 |
| 949: | DQ477678 | gi:91990698 | 1009: | DQ477618 | gi:91990578 | 1069: | DQ477558 | gi:91990458 |
| 950: | DQ477677 | gi:91990696 | 1010: | DQ477617 | gi:91990576 | 1070: | DQ477557 | gi:91990456 |
| 951: | DQ477676 | gi:91990694 | 1011: | DQ477616 | gi:91990574 | 1071: | DQ477556 | gi:91990454 |
| 952: | DQ477675 | gi:91990692 | 1012: | DQ477615 | gi:91990572 | 1072: | DQ477555 | gi:91990452 |
| 953: | DQ477674 | gi:91990690 | 1013: | DQ477614 | gi:91990570 | 1073: | DQ477554 | gi:91990450 |
| 954: | DQ477673 | gi:91990688 | 1014: | DQ477613 | gi:91990568 | 1074: | DQ477553 | gi:91990448 |
| 955: | DQ477672 | gi:91990686 | 1015: | DQ477612 | gi:91990566 | 1075: | DQ477552 | gi:91990446 |
| 956: | DQ477671 | gi:91990684 | 1016: | DQ477611 | gi:91990564 | 1076: | DQ477551 | gi:91990444 |
| 957: | DQ477670 | gi:91990682 | 1017: | DQ477610 | gi:91990562 | 1077: | DQ477550 | gi:91990442 |
| 958: | DQ477669 | gi:91990680 | 1018: | DQ477609 | gi:91990560 | 1078: | DQ477549 | gi:91990440 |
| 959: | DQ477668 | gi:91990678 | 1019: | DQ477608 | gi:91990558 | 1079: | DQ477548 | gi:91990438 |
| 960: | DQ477667 | gi:91990676 | 1020: | DQ477607 | gi:91990556 | 1080: | DQ477547 | gi:91990436 |

| Accession No. | | GI No. | Accession No. | | GI No. | Accession No. | | GI No. |
|---|---|---|---|---|---|---|---|---|
| 1081: | DQ477546 | gi:91990434 | 1141: | DQ477486 | gi:91990314 | 1201: | DQ477426 | gi:91990194 |
| 1082: | DQ477545 | gi:91990432 | 1142: | DQ477485 | gi:91990312 | 1202: | DQ477425 | gi:91990192 |
| 1083: | DQ477544 | gi:91990430 | 1143: | DQ477484 | gi:91990310 | 1203: | DQ477424 | gi:91990190 |
| 1084: | DQ477543 | gi:91990428 | 1144: | DQ477483 | gi:91990308 | 1204: | DQ477423 | gi:91990188 |

FIG. 6 (con't)

| | | | | | | | | |
|---|---|---|---|---|---|---|---|---|
| 1085: | DQ477542 | gi:91990426 | 1145: | DQ477482 | gi:91990306 | 1205: | DQ477422 | gi:91990186 |
| 1086: | DQ477541 | gi:91990424 | 1146: | DQ477481 | gi:91990304 | 1206: | DQ477421 | gi:91990184 |
| 1087: | DQ477540 | gi:91990422 | 1147: | DQ477480 | gi:91990302 | 1207: | DQ477420 | gi:91990182 |
| 1088: | DQ477539 | gi:91990420 | 1148: | DQ477479 | gi:91990300 | 1208: | DQ477419 | gi:91990180 |
| 1089: | DQ477538 | gi:91990418 | 1149: | DQ477478 | gi:91990298 | 1209: | DQ477418 | gi:91990178 |
| 1090: | DQ477537 | gi:91990416 | 1150: | DQ477477 | gi:91990296 | 1210: | DQ477417 | gi:91990176 |
| 1091: | DQ477536 | gi:91990414 | 1151: | DQ477476 | gi:91990294 | 1211: | DQ477416 | gi:91990174 |
| 1092: | DQ477535 | gi:91990412 | 1152: | DQ477475 | gi:91990292 | 1212: | DQ477415 | gi:91990172 |
| 1093: | DQ477534 | gi:91990410 | 1153: | DQ477474 | gi:91990290 | 1213: | DQ477414 | gi:91990170 |
| 1094: | DQ477533 | gi:91990408 | 1154: | DQ477473 | gi:91990288 | 1214: | DQ477413 | gi:91990168 |
| 1095: | DQ477532 | gi:91990406 | 1155: | DQ477472 | gi:91990286 | 1215: | DQ477412 | gi:91990166 |
| 1096: | DQ477531 | gi:91990404 | 1156: | DQ477471 | gi:91990284 | 1216: | DQ477411 | gi:91990164 |
| 1097: | DQ477530 | gi:91990402 | 1157: | DQ477470 | gi:91990282 | 1217: | DQ477410 | gi:91990162 |
| 1098: | DQ477529 | gi:91990400 | 1158: | DQ477469 | gi:91990280 | 1218: | DQ477409 | gi:91990160 |
| 1099: | DQ477528 | gi:91990398 | 1159: | DQ477468 | gi:91990278 | 1219: | DQ477408 | gi:91990158 |
| 1100: | DQ477527 | gi:91990396 | 1160: | DQ477467 | gi:91990276 | 1220: | DQ477407 | gi:91990156 |
| 1101: | DQ477526 | gi:91990394 | 1161: | DQ477466 | gi:91990274 | 1221: | DQ477406 | gi:91990154 |
| 1102: | DQ477525 | gi:91990392 | 1162: | DQ477465 | gi:91990272 | 1222: | DQ477405 | gi:91990152 |
| 1103: | DQ477524 | gi:91990390 | 1163: | DQ477464 | gi:91990270 | 1223: | DQ477404 | gi:91990150 |
| 1104: | DQ477523 | gi:91990388 | 1164: | DQ477463 | gi:91990268 | 1224: | DQ477403 | gi:91990148 |
| 1105: | DQ477522 | gi:91990386 | 1165: | DQ477462 | gi:91990266 | 1225: | DQ477402 | gi:91990146 |
| 1106: | DQ477521 | gi:91990384 | 1166: | DQ477461 | gi:91990264 | 1226: | DQ477401 | gi:91990144 |
| 1107: | DQ477520 | gi:91990382 | 1167: | DQ477460 | gi:91990262 | 1227: | DQ477400 | gi:91990142 |
| 1108: | DQ477519 | gi:91990380 | 1168: | DQ477459 | gi:91990260 | 1228: | DQ477399 | gi:91990140 |
| 1109: | DQ477518 | gi:91990378 | 1169: | DQ477458 | gi:91990258 | 1229: | DQ477398 | gi:91990138 |
| 1110: | DQ477517 | gi:91990376 | 1170: | DQ477457 | gi:91990256 | 1230: | DQ477397 | gi:91990136 |
| 1111: | DQ477516 | gi:91990374 | 1171: | DQ477456 | gi:91990254 | 1231: | DQ477396 | gi:91990134 |
| 1112: | DQ477515 | gi:91990372 | 1172: | DQ477455 | gi:91990252 | 1232: | DQ477395 | gi:91990132 |
| 1113: | DQ477514 | gi:91990370 | 1173: | DQ477454 | gi:91990250 | 1233: | DQ477394 | gi:91990130 |
| 1114: | DQ477513 | gi:91990368 | 1174: | DQ477453 | gi:91990248 | 1234: | DQ477393 | gi:91990128 |
| 1115: | DQ477512 | gi:91990366 | 1175: | DQ477452 | gi:91990246 | 1235: | DQ477392 | gi:91990126 |
| 1116: | DQ477511 | gi:91990364 | 1176: | DQ477451 | gi:91990244 | 1236: | DQ477391 | gi:91990124 |
| 1117: | DQ477510 | gi:91990362 | 1177: | DQ477450 | gi:91990242 | 1237: | DQ477390 | gi:91990122 |
| 1118: | DQ477509 | gi:91990360 | 1178: | DQ477449 | gi:91990240 | 1238: | DQ477389 | gi:91990120 |
| 1119: | DQ477508 | gi:91990358 | 1179: | DQ477448 | gi:91990238 | 1239: | DQ477388 | gi:91990118 |
| 1120: | DQ477507 | gi:91990356 | 1180: | DQ477447 | gi:91990236 | 1240: | DQ477387 | gi:91990116 |
| 1121: | DQ477506 | gi:91990354 | 1181: | DQ477446 | gi:91990234 | 1241: | DQ477386 | gi:91990114 |
| 1122: | DQ477505 | gi:91990352 | 1182: | DQ477445 | gi:91990232 | 1242: | DQ477385 | gi:91990112 |

FIG. 6 (con't)

| | | | | | | | | |
|---|---|---|---|---|---|---|---|---|
| 1123: | DQ477504 | gi:91990350 | 1183: | DQ477444 | gi:91990230 | 1243: | DQ477384 | gi:91990110 |
| 1124: | DQ477503 | gi:91990348 | 1184: | DQ477443 | gi:91990228 | 1244: | DQ477383 | gi:91990108 |
| 1125: | DQ477502 | gi:91990346 | 1185: | DQ477442 | gi:91990226 | 1245: | DQ477382 | gi:91990106 |
| 1126: | DQ477501 | gi:91990344 | 1186: | DQ477441 | gi:91990224 | 1246: | DQ477381 | gi:91990104 |
| 1127: | DQ477500 | gi:91990342 | 1187: | DQ477440 | gi:91990222 | 1247: | DQ477380 | gi:91990102 |
| 1128: | DQ477499 | gi:91990340 | 1188: | DQ477439 | gi:91990220 | 1248: | DQ477379 | gi:91990100 |
| 1129: | DQ477498 | gi:91990338 | 1189: | DQ477438 | gi:91990218 | 1249: | DQ477378 | gi:91990098 |
| 1130: | DQ477497 | gi:91990336 | 1190: | DQ477437 | gi:91990216 | 1250: | DQ477377 | gi:91990096 |
| 1131: | DQ477496 | gi:91990334 | 1191: | DQ477436 | gi:91990214 | 1251: | DQ477376 | gi:91990094 |
| 1132: | DQ477495 | gi:91990332 | 1192: | DQ477435 | gi:91990212 | 1252: | DQ477375 | gi:91990092 |
| 1133: | DQ477494 | gi:91990330 | 1193: | DQ477434 | gi:91990210 | 1253: | DQ477374 | gi:91990090 |
| 1134: | DQ477493 | gi:91990328 | 1194: | DQ477433 | gi:91990208 | 1254: | DQ477373 | gi:91990088 |
| 1135: | DQ477492 | gi:91990326 | 1195: | DQ477432 | gi:91990206 | 1255: | DQ477372 | gi:91990086 |
| 1136: | DQ477491 | gi:91990324 | 1196: | DQ477431 | gi:91990204 | 1256: | DQ477371 | gi:91990084 |
| 1137: | DQ477490 | gi:91990322 | 1197: | DQ477430 | gi:91990202 | 1257: | DQ477370 | gi:91990082 |
| 1138: | DQ477489 | gi:91990320 | 1198: | DQ477429 | gi:91990200 | 1258: | DQ477369 | gi:91990080 |
| 1139: | DQ477488 | gi:91990318 | 1199: | DQ477428 | gi:91990198 | 1259: | DQ477368 | gi:91990078 |
| 1140: | DQ477487 | gi:91990316 | 1200: | DQ477427 | gi:91990196 | 1260: | DQ477367 | gi:91990076 |

| Accession No. | | GI No. | Accession No. | | GI No. | Accession No. | | GI No. |
|---|---|---|---|---|---|---|---|---|
| 1261: | DQ477366 | gi:91990074 | 1321: | DQ477306 | gi:91989954 | 1381: | DQ477246 | gi:91989834 |
| 1262: | DQ477365 | gi:91990072 | 1322: | DQ477305 | gi:91989952 | 1382: | DQ477245 | gi:91989832 |
| 1263: | DQ477364 | gi:91990070 | 1323: | DQ477304 | gi:91989950 | 1383: | DQ477244 | gi:91989830 |
| 1264: | DQ477363 | gi:91990068 | 1324: | DQ477303 | gi:91989948 | 1384: | DQ477243 | gi:91989828 |
| 1265: | DQ477362 | gi:91990066 | 1325: | DQ477302 | gi:91989946 | 1385: | DQ477242 | gi:91989826 |
| 1266: | DQ477361 | gi:91990064 | 1326: | DQ477301 | gi:91989944 | 1386: | DQ477241 | gi:91989824 |
| 1267: | DQ477360 | gi:91990062 | 1327: | DQ477300 | gi:91989942 | 1387: | DQ477240 | gi:91989822 |
| 1268: | DQ477359 | gi:91990060 | 1328: | DQ477299 | gi:91989940 | 1388: | DQ477239 | gi:91989820 |
| 1269: | DQ477358 | gi:91990058 | 1329: | DQ477298 | gi:91989938 | 1389: | DQ477238 | gi:91989818 |
| 1270: | DQ477357 | gi:91990056 | 1330: | DQ477297 | gi:91989936 | 1390: | DQ477237 | gi:91989816 |
| 1271: | DQ477356 | gi:91990054 | 1331: | DQ477296 | gi:91989934 | 1391: | DQ477236 | gi:91989814 |
| 1272: | DQ477355 | gi:91990052 | 1332: | DQ477295 | gi:91989932 | 1392: | DQ477235 | gi:91989812 |
| 1273: | DQ477354 | gi:91990050 | 1333: | DQ477294 | gi:91989930 | 1393: | DQ477234 | gi:91989810 |
| 1274: | DQ477353 | gi:91990048 | 1334: | DQ477293 | gi:91989928 | 1394: | DQ477233 | gi:91989808 |
| 1275: | DQ477352 | gi:91990046 | 1335: | DQ477292 | gi:91989926 | 1395: | DQ477232 | gi:91989806 |
| 1276: | DQ477351 | gi:91990044 | 1336: | DQ477291 | gi:91989924 | 1396: | DQ477231 | gi:91989804 |
| 1277: | DQ477350 | gi:91990042 | 1337: | DQ477290 | gi:91989922 | 1397: | DQ477230 | gi:91989802 |
| 1278: | DQ477349 | gi:91990040 | 1338: | DQ477289 | gi:91989920 | 1398: | DQ477229 | gi:91989800 |

FIG. 6 (con't)

| | | | | | | | | |
|---|---|---|---|---|---|---|---|---|
| 1279: | DQ477348 | gi:91990038 | 1339: | DQ477288 | gi:91989918 | 1399: | DQ477228 | gi:91989798 |
| 1280: | DQ477347 | gi:91990036 | 1340: | DQ477287 | gi:91989916 | 1400: | DQ477227 | gi:91989796 |
| 1281: | DQ477346 | gi:91990034 | 1341: | DQ477286 | gi:91989914 | 1401: | DQ477226 | gi:91989794 |
| 1282: | DQ477345 | gi:91990032 | 1342: | DQ477285 | gi:91989912 | 1402: | DQ477225 | gi:91989792 |
| 1283: | DQ477344 | gi:91990030 | 1343: | DQ477284 | gi:91989910 | 1403: | DQ477224 | gi:91989790 |
| 1284: | DQ477343 | gi:91990028 | 1344: | DQ477283 | gi:91989908 | 1404: | DQ477223 | gi:91989788 |
| 1285: | DQ477342 | gi:91990026 | 1345: | DQ477282 | gi:91989906 | 1405: | DQ477222 | gi:91989786 |
| 1286: | DQ477341 | gi:91990024 | 1346: | DQ477281 | gi:91989904 | 1406: | DQ477221 | gi:91989784 |
| 1287: | DQ477340 | gi:91990022 | 1347: | DQ477280 | gi:91989902 | 1407: | DQ477220 | gi:91989782 |
| 1288: | DQ477339 | gi:91990020 | 1348: | DQ477279 | gi:91989900 | 1408: | DQ477219 | gi:91989780 |
| 1289: | DQ477338 | gi:91990018 | 1349: | DQ477278 | gi:91989898 | 1409: | DQ477218 | gi:91989778 |
| 1290: | DQ477337 | gi:91990016 | 1350: | DQ477277 | gi:91989896 | 1410: | DQ477217 | gi:91989776 |
| 1291: | DQ477336 | gi:91990014 | 1351: | DQ477276 | gi:91989894 | 1411: | DQ477216 | gi:91989774 |
| 1292: | DQ477335 | gi:91990012 | 1352: | DQ477275 | gi:91989892 | 1412: | DQ477215 | gi:91989772 |
| 1293: | DQ477334 | gi:91990010 | 1353: | DQ477274 | gi:91989890 | 1413: | DQ477214 | gi:91989770 |
| 1294: | DQ477333 | gi:91990008 | 1354: | DQ477273 | gi:91989888 | 1414: | DQ477213 | gi:91989768 |
| 1295: | DQ477332 | gi:91990006 | 1355: | DQ477272 | gi:91989886 | 1415: | DQ477212 | gi:91989766 |
| 1296: | DQ477331 | gi:91990004 | 1356: | DQ477271 | gi:91989884 | 1416: | DQ477211 | gi:91989764 |
| 1297: | DQ477330 | gi:91990002 | 1357: | DQ477270 | gi:91989882 | 1417: | DQ477210 | gi:91989762 |
| 1298: | DQ477329 | gi:91990000 | 1358: | DQ477269 | gi:91989880 | 1418: | DQ477209 | gi:91989760 |
| 1299: | DQ477328 | gi:91989998 | 1359: | DQ477268 | gi:91989878 | 1419: | DQ477208 | gi:91989758 |
| 1300: | DQ477327 | gi:91989996 | 1360: | DQ477267 | gi:91989876 | 1420: | DQ477207 | gi:91989756 |
| 1301: | DQ477326 | gi:91989994 | 1361: | DQ477266 | gi:91989874 | 1421: | DQ477206 | gi:91989754 |
| 1302: | DQ477325 | gi:91989992 | 1362: | DQ477265 | gi:91989872 | 1422: | DQ477205 | gi:91989752 |
| 1303: | DQ477324 | gi:91989990 | 1363: | DQ477264 | gi:91989870 | 1423: | DQ477204 | gi:91989750 |
| 1304: | DQ477323 | gi:91989988 | 1364: | DQ477263 | gi:91989868 | 1424: | DQ477203 | gi:91989748 |
| 1305: | DQ477322 | gi:91989986 | 1365: | DQ477262 | gi:91989866 | 1425: | DQ477202 | gi:91989746 |
| 1306: | DQ477321 | gi:91989984 | 1366: | DQ477261 | gi:91989864 | 1426: | DQ477201 | gi:91989744 |
| 1307: | DQ477320 | gi:91989982 | 1367: | DQ477260 | gi:91989862 | 1427: | DQ477200 | gi:91989742 |
| 1308: | DQ477319 | gi:91989980 | 1368: | DQ477259 | gi:91989860 | 1428: | DQ477199 | gi:91989740 |
| 1309: | DQ477318 | gi:91989978 | 1369: | DQ477258 | gi:91989858 | 1429: | DQ477198 | gi:91989738 |
| 1310: | DQ477317 | gi:91989976 | 1370: | DQ477257 | gi:91989856 | 1430: | DQ477197 | gi:91989736 |
| 1311: | DQ477316 | gi:91989974 | 1371: | DQ477256 | gi:91989854 | 1431: | DQ477196 | gi:91989734 |
| 1312: | DQ477315 | gi:91989972 | 1372: | DQ477255 | gi:91989852 | 1432: | DQ477195 | gi:91989732 |
| 1313: | DQ477314 | gi:91989970 | 1373: | DQ477254 | gi:91989850 | 1433: | DQ477194 | gi:91989730 |
| 1314: | DQ477313 | gi:91989968 | 1374: | DQ477253 | gi:91989848 | 1434: | DQ477193 | gi:91989728 |
| 1315: | DQ477312 | gi:91989966 | 1375: | DQ477252 | gi:91989846 | 1435: | DQ477192 | gi:91989726 |
| 1316: | DQ477311 | gi:91989964 | 1376: | DQ477251 | gi:91989844 | 1436: | DQ477191 | gi:91989724 |

FIG. 6 (con't)

| | | | | | | | | |
|---|---|---|---|---|---|---|---|---|
| 1317: | DQ477310 | gi:91989962 | 1377: | DQ477250 | gi:91989842 | 1437: | DQ477190 | gi:91989722 |
| 1318: | DQ477309 | gi:91989960 | 1378: | DQ477249 | gi:91989840 | 1438: | DQ477189 | gi:91989720 |
| 1319: | DQ477308 | gi:91989958 | 1379: | DQ477248 | gi:91989838 | 1439: | DQ477188 | gi:91989718 |
| 1320: | DQ477307 | gi:91989956 | 1380: | DQ477247 | gi:91989836 | 1440: | DQ477187 | gi:91989716 |

| Accession No. | | GI No. | Accession No. | | GI No. | Accession No. | | GI No. |
|---|---|---|---|---|---|---|---|---|
| 1441: | DQ477186 | gi:91989714 | 1501: | DQ477126 | gi:91989594 | 1561: | DQ477066 | gi:91989474 |
| 1442: | DQ477185 | gi:91989712 | 1502: | DQ477125 | gi:91989592 | 1562: | DQ477065 | gi:91989472 |
| 1443: | DQ477184 | gi:91989710 | 1503: | DQ477124 | gi:91989590 | 1563: | DQ477064 | gi:91989470 |
| 1444: | DQ477183 | gi:91989708 | 1504: | DQ477123 | gi:91989588 | 1564: | DQ477063 | gi:91989468 |
| 1445: | DQ477182 | gi:91989706 | 1505: | DQ477122 | gi:91989586 | 1565: | DQ477062 | gi:91989466 |
| 1446: | DQ477181 | gi:91989704 | 1506: | DQ477121 | gi:91989584 | 1566: | DQ477061 | gi:91989464 |
| 1447: | DQ477180 | gi:91989702 | 1507: | DQ477120 | gi:91989582 | 1567: | DQ477060 | gi:91989462 |
| 1448: | DQ477179 | gi:91989700 | 1508: | DQ477119 | gi:91989580 | 1568: | DQ477059 | gi:91989460 |
| 1449: | DQ477178 | gi:91989698 | 1509: | DQ477118 | gi:91989578 | 1569: | DQ477058 | gi:91989458 |
| 1450: | DQ477177 | gi:91989696 | 1510: | DQ477117 | gi:91989576 | 1570: | DQ477057 | gi:91989456 |
| 1451: | DQ477176 | gi:91989694 | 1511: | DQ477116 | gi:91989574 | 1571: | DQ477056 | gi:91989454 |
| 1452: | DQ477175 | gi:91989692 | 1512: | DQ477115 | gi:91989572 | 1572: | DQ477055 | gi:91989452 |
| 1453: | DQ477174 | gi:91989690 | 1513: | DQ477114 | gi:91989570 | 1573: | DQ477054 | gi:91989450 |
| 1454: | DQ477173 | gi:91989688 | 1514: | DQ477113 | gi:91989568 | 1574: | DQ477053 | gi:91989448 |
| 1455: | DQ477172 | gi:91989686 | 1515: | DQ477112 | gi:91989566 | 1575: | DQ477052 | gi:91989446 |
| 1456: | DQ477171 | gi:91989684 | 1516: | DQ477111 | gi:91989564 | 1576: | DQ477051 | gi:91989444 |
| 1457: | DQ477170 | gi:91989682 | 1517: | DQ477110 | gi:91989562 | 1577: | DQ477050 | gi:91989442 |
| 1458: | DQ477169 | gi:91989680 | 1518: | DQ477109 | gi:91989560 | 1578: | DQ477049 | gi:91989440 |
| 1459: | DQ477168 | gi:91989678 | 1519: | DQ477108 | gi:91989558 | 1579: | DQ477048 | gi:91989438 |
| 1460: | DQ477167 | gi:91989676 | 1520: | DQ477107 | gi:91989556 | 1580: | DQ477047 | gi:91989436 |
| 1461: | DQ477166 | gi:91989674 | 1521: | DQ477106 | gi:91989554 | 1581: | DQ477046 | gi:91989434 |
| 1462: | DQ477165 | gi:91989672 | 1522: | DQ477105 | gi:91989552 | 1582: | DQ477045 | gi:91989432 |
| 1463: | DQ477164 | gi:91989670 | 1523: | DQ477104 | gi:91989550 | 1583: | DQ477044 | gi:91989430 |
| 1464: | DQ477163 | gi:91989668 | 1524: | DQ477103 | gi:91989548 | 1584: | DQ477043 | gi:91989428 |
| 1465: | DQ477162 | gi:91989666 | 1525: | DQ477102 | gi:91989546 | 1585: | DQ477042 | gi:91989426 |
| 1466: | DQ477161 | gi:91989664 | 1526: | DQ477101 | gi:91989544 | 1586: | DQ477041 | gi:91989424 |
| 1467: | DQ477160 | gi:91989662 | 1527: | DQ477100 | gi:91989542 | 1587: | DQ477040 | gi:91989422 |
| 1468: | DQ477159 | gi:91989660 | 1528: | DQ477099 | gi:91989540 | 1588: | DQ477039 | gi:91989420 |
| 1469: | DQ477158 | gi:91989658 | 1529: | DQ477098 | gi:91989538 | 1589: | DQ477038 | gi:91989418 |
| 1470: | DQ477157 | gi:91989656 | 1530: | DQ477097 | gi:91989536 | 1590: | DQ477037 | gi:91989416 |
| 1471: | DQ477156 | gi:91989654 | 1531: | DQ477096 | gi:91989534 | 1591: | DQ477036 | gi:91989414 |
| 1472: | DQ477155 | gi:91989652 | 1532: | DQ477095 | gi:91989532 | 1592: | DQ477035 | gi:91989412 |

FIG. 6 (con't)

| | | | | | | | | |
|---|---|---|---|---|---|---|---|---|
| 1473: | DQ477154 | gi:91989650 | 1533: | DQ477094 | gi:91989530 | 1593: | DQ477034 | gi:91989410 |
| 1474: | DQ477153 | gi:91989648 | 1534: | DQ477093 | gi:91989528 | 1594: | DQ477033 | gi:91989408 |
| 1475: | DQ477152 | gi:91989646 | 1535: | DQ477092 | gi:91989526 | 1595: | DQ477032 | gi:91989406 |
| 1476: | DQ477151 | gi:91989644 | 1536: | DQ477091 | gi:91989524 | 1596: | DQ477031 | gi:91989404 |
| 1477: | DQ477150 | gi:91989642 | 1537: | DQ477090 | gi:91989522 | 1597: | DQ477030 | gi:91989402 |
| 1478: | DQ477149 | gi:91989640 | 1538: | DQ477089 | gi:91989520 | 1598: | DQ477029 | gi:91989400 |
| 1479: | DQ477148 | gi:91989638 | 1539: | DQ477088 | gi:91989518 | 1599: | DQ477028 | gi:91989398 |
| 1480: | DQ477147 | gi:91989636 | 1540: | DQ477087 | gi:91989516 | 1600: | DQ477027 | gi:91989396 |
| 1481: | DQ477146 | gi:91989634 | 1541: | DQ477086 | gi:91989514 | 1601: | DQ477026 | gi:91989394 |
| 1482: | DQ477145 | gi:91989632 | 1542: | DQ477085 | gi:91989512 | 1602: | DQ477025 | gi:91989392 |
| 1483: | DQ477144 | gi:91989630 | 1543: | DQ477084 | gi:91989510 | 1603: | DQ477024 | gi:91989390 |
| 1484: | DQ477143 | gi:91989628 | 1544: | DQ477083 | gi:91989508 | 1604: | DQ477023 | gi:91989388 |
| 1485: | DQ477142 | gi:91989626 | 1545: | DQ477082 | gi:91989506 | 1605: | DQ477022 | gi:91989386 |
| 1486: | DQ477141 | gi:91989624 | 1546: | DQ477081 | gi:91989504 | 1606: | DQ477021 | gi:91989384 |
| 1487: | DQ477140 | gi:91989622 | 1547: | DQ477080 | gi:91989502 | 1607: | DQ477020 | gi:91989382 |
| 1488: | DQ477139 | gi:91989620 | 1548: | DQ477079 | gi:91989500 | 1608: | DQ477019 | gi:91989380 |
| 1489: | DQ477138 | gi:91989618 | 1549: | DQ477078 | gi:91989498 | 1609: | DQ477018 | gi:91989378 |
| 1490: | DQ477137 | gi:91989616 | 1550: | DQ477077 | gi:91989496 | 1610: | DQ477017 | gi:91989376 |
| 1491: | DQ477136 | gi:91989614 | 1551: | DQ477076 | gi:91989494 | 1611: | DQ477016 | gi:91989374 |
| 1492: | DQ477135 | gi:91989612 | 1552: | DQ477075 | gi:91989492 | 1612: | DQ477015 | gi:91989372 |
| 1493: | DQ477134 | gi:91989610 | 1553: | DQ477074 | gi:91989490 | 1613: | DQ477014 | gi:91989370 |
| 1494: | DQ477133 | gi:91989608 | 1554: | DQ477073 | gi:91989488 | 1614: | DQ477013 | gi:91989368 |
| 1495: | DQ477132 | gi:91989606 | 1555: | DQ477072 | gi:91989486 | 1615: | DQ477012 | gi:91989366 |
| 1496: | DQ477131 | gi:91989604 | 1556: | DQ477071 | gi:91989484 | 1616: | DQ477011 | gi:91989364 |
| 1497: | DQ477130 | gi:91989602 | 1557: | DQ477070 | gi:91989482 | 1617: | DQ477010 | gi:91989362 |
| 1498: | DQ477129 | gi:91989600 | 1558: | DQ477069 | gi:91989480 | 1618: | DQ477009 | gi:91989360 |
| 1499: | DQ477128 | gi:91989598 | 1559: | DQ477068 | gi:91989478 | 1619: | DQ477008 | gi:91989358 |
| 1500: | DQ477127 | gi:91989596 | 1560: | DQ477067 | gi:91989476 | 1620: | DQ477007 | gi:91989356 |

| Accession No. | | GI No. | Accession No. | | GI No. | Accession No. | | GI No. |
|---|---|---|---|---|---|---|---|---|
| 1621: | DQ477006 | gi:91989354 | 1681: | DQ476946 | gi:91989234 | 1741: | DQ476886 | gi:91989114 |
| 1622: | DQ477005 | gi:91989352 | 1682: | DQ476945 | gi:91989232 | 1742: | DQ476885 | gi:91989112 |
| 1623: | DQ477004 | gi:91989350 | 1683: | DQ476944 | gi:91989230 | 1743: | DQ476884 | gi:91989110 |
| 1624: | DQ477003 | gi:91989348 | 1684: | DQ476943 | gi:91989228 | 1744: | DQ476883 | gi:91989108 |
| 1625: | DQ477002 | gi:91989346 | 1685: | DQ476942 | gi:91989226 | 1745: | DQ476882 | gi:91989106 |
| 1626: | DQ477001 | gi:91989344 | 1686: | DQ476941 | gi:91989224 | 1746: | DQ476881 | gi:91989104 |
| 1627: | DQ477000 | gi:91989342 | 1687: | DQ476940 | gi:91989222 | 1747: | DQ476880 | gi:91989102 |
| 1628: | DQ476999 | gi:91989340 | 1688: | DQ476939 | gi:91989220 | 1748: | DQ476879 | gi:91989100 |

FIG. 6 (con't)

| | | | | | | | | |
|---|---|---|---|---|---|---|---|---|
| 1629: | DQ476998 | gi:91989338 | 1689: | DQ476938 | gi:91989218 | 1749: | DQ476878 | gi:91989098 |
| 1630: | DQ476997 | gi:91989336 | 1690: | DQ476937 | gi:91989216 | 1750: | DQ476877 | gi:91989096 |
| 1631: | DQ476996 | gi:91989334 | 1691: | DQ476936 | gi:91989214 | 1751: | DQ476876 | gi:91989094 |
| 1632: | DQ476995 | gi:91989332 | 1692: | DQ476935 | gi:91989212 | 1752: | DQ476875 | gi:91989092 |
| 1633: | DQ476994 | gi:91989330 | 1693: | DQ476934 | gi:91989210 | 1753: | DQ476874 | gi:91989090 |
| 1634: | DQ476993 | gi:91989328 | 1694: | DQ476933 | gi:91989208 | 1754: | DQ476873 | gi:91989088 |
| 1635: | DQ476992 | gi:91989326 | 1695: | DQ476932 | gi:91989206 | 1755: | DQ476872 | gi:91989086 |
| 1636: | DQ476991 | gi:91989324 | 1696: | DQ476931 | gi:91989204 | 1756: | DQ476871 | gi:91989084 |
| 1637: | DQ476990 | gi:91989322 | 1697: | DQ476930 | gi:91989202 | 1757: | DQ476870 | gi:91989082 |
| 1638: | DQ476989 | gi:91989320 | 1698: | DQ476929 | gi:91989200 | 1758: | DQ476869 | gi:91989080 |
| 1639: | DQ476988 | gi:91989318 | 1699: | DQ476928 | gi:91989198 | 1759: | DQ476868 | gi:91989078 |
| 1640: | DQ476987 | gi:91989316 | 1700: | DQ476927 | gi:91989196 | 1760: | DQ476867 | gi:91989076 |
| 1641: | DQ476986 | gi:91989314 | 1701: | DQ476926 | gi:91989194 | 1761: | DQ476866 | gi:91989074 |
| 1642: | DQ476985 | gi:91989312 | 1702: | DQ476925 | gi:91989192 | 1762: | DQ476865 | gi:91989072 |
| 1643: | DQ476984 | gi:91989310 | 1703: | DQ476924 | gi:91989190 | 1763: | DQ476864 | gi:91989070 |
| 1644: | DQ476983 | gi:91989308 | 1704: | DQ476923 | gi:91989188 | 1764: | DQ476863 | gi:91989068 |
| 1645: | DQ476982 | gi:91989306 | 1705: | DQ476922 | gi:91989186 | 1765: | DQ476862 | gi:91989066 |
| 1646: | DQ476981 | gi:91989304 | 1706: | DQ476921 | gi:91989184 | 1766: | DQ476861 | gi:91989064 |
| 1647: | DQ476980 | gi:91989302 | 1707: | DQ476920 | gi:91989182 | 1767: | DQ476860 | gi:91989062 |
| 1648: | DQ476979 | gi:91989300 | 1708: | DQ476919 | gi:91989180 | 1768: | DQ476859 | gi:91989060 |
| 1649: | DQ476978 | gi:91989298 | 1709: | DQ476918 | gi:91989178 | 1769: | DQ476858 | gi:91989058 |
| 1650: | DQ476977 | gi:91989296 | 1710: | DQ476917 | gi:91989176 | 1770: | DQ476857 | gi:91989056 |
| 1651: | DQ476976 | gi:91989294 | 1711: | DQ476916 | gi:91989174 | 1771: | DQ476856 | gi:91989054 |
| 1652: | DQ476975 | gi:91989292 | 1712: | DQ476915 | gi:91989172 | 1772: | DQ476855 | gi:91989052 |
| 1653: | DQ476974 | gi:91989290 | 1713: | DQ476914 | gi:91989170 | 1773: | DQ476854 | gi:91989050 |
| 1654: | DQ476973 | gi:91989288 | 1714: | DQ476913 | gi:91989168 | 1774: | DQ476853 | gi:91989048 |
| 1655: | DQ476972 | gi:91989286 | 1715: | DQ476912 | gi:91989166 | 1775: | DQ476852 | gi:91989046 |
| 1656: | DQ476971 | gi:91989284 | 1716: | DQ476911 | gi:91989164 | 1776: | DQ476851 | gi:91989044 |
| 1657: | DQ476970 | gi:91989282 | 1717: | DQ476910 | gi:91989162 | 1777: | DQ476850 | gi:91989042 |
| 1658: | DQ476969 | gi:91989280 | 1718: | DQ476909 | gi:91989160 | 1778: | DQ476849 | gi:91989040 |
| 1659: | DQ476968 | gi:91989278 | 1719: | DQ476908 | gi:91989158 | 1779: | DQ476848 | gi:91989038 |
| 1660: | DQ476967 | gi:91989276 | 1720: | DQ476907 | gi:91989156 | 1780: | DQ476847 | gi:91989036 |
| 1661: | DQ476966 | gi:91989274 | 1721: | DQ476906 | gi:91989154 | 1781: | DQ476846 | gi:91989034 |
| 1662: | DQ476965 | gi:91989272 | 1722: | DQ476905 | gi:91989152 | 1782: | DQ476845 | gi:91989032 |
| 1663: | DQ476964 | gi:91989270 | 1723: | DQ476904 | gi:91989150 | 1783: | DQ476844 | gi:91989030 |
| 1664: | DQ476963 | gi:91989268 | 1724: | DQ476903 | gi:91989148 | 1784: | DQ476843 | gi:91989028 |
| 1665: | DQ476962 | gi:91989266 | 1725: | DQ476902 | gi:91989146 | 1785: | DQ476842 | gi:91989026 |
| 1666: | DQ476961 | gi:91989264 | 1726: | DQ476901 | gi:91989144 | 1786: | DQ476841 | gi:91989024 |

FIG. 6 (con't)

| | | | | | | | | |
|---|---|---|---|---|---|---|---|---|
| 1667: | DQ476960 | gi:91989262 | 1727: | DQ476900 | gi:91989142 | 1787: | DQ476840 | gi:91989022 |
| 1668: | DQ476959 | gi:91989260 | 1728: | DQ476899 | gi:91989140 | 1788: | DQ476839 | gi:91989020 |
| 1669: | DQ476958 | gi:91989258 | 1729: | DQ476898 | gi:91989138 | 1789: | DQ476838 | gi:91989018 |
| 1670: | DQ476957 | gi:91989256 | 1730: | DQ476897 | gi:91989136 | 1790: | DQ476837 | gi:91989016 |
| 1671: | DQ476956 | gi:91989254 | 1731: | DQ476896 | gi:91989134 | 1791: | DQ476836 | gi:91989014 |
| 1672: | DQ476955 | gi:91989252 | 1732: | DQ476895 | gi:91989132 | 1792: | DQ476835 | gi:91989012 |
| 1673: | DQ476954 | gi:91989250 | 1733: | DQ476894 | gi:91989130 | 1793: | DQ476834 | gi:91989010 |
| 1674: | DQ476953 | gi:91989248 | 1734: | DQ476893 | gi:91989128 | 1794: | DQ476833 | gi:91989008 |
| 1675: | DQ476952 | gi:91989246 | 1735: | DQ476892 | gi:91989126 | 1795: | DQ476832 | gi:91989006 |
| 1676: | DQ476951 | gi:91989244 | 1736: | DQ476891 | gi:91989124 | 1796: | DQ476831 | gi:91989004 |
| 1677: | DQ476950 | gi:91989242 | 1737: | DQ476890 | gi:91989122 | 1797: | DQ476830 | gi:91989002 |
| 1678: | DQ476949 | gi:91989240 | 1738: | DQ476889 | gi:91989120 | 1798: | DQ476829 | gi:91989000 |
| 1679: | DQ476948 | gi:91989238 | 1739: | DQ476888 | gi:91989118 | 1799: | DQ476828 | gi:91988998 |
| 1680: | DQ476947 | gi:91989236 | 1740: | DQ476887 | gi:91989116 | 1800: | DQ476827 | gi:91988996 |

| Accession No. | | GI No. | Accession No. | | GI No. | Accession No. | | GI No. |
|---|---|---|---|---|---|---|---|---|
| 1801: | DQ476826 | gi:91988994 | 1861: | DQ476766 | gi:91988874 | 1921: | DQ476706 | gi:91988754 |
| 1802: | DQ476825 | gi:91988992 | 1862: | DQ476765 | gi:91988872 | 1922: | DQ476705 | gi:91988752 |
| 1803: | DQ476824 | gi:91988990 | 1863: | DQ476764 | gi:91988870 | 1923: | DQ476704 | gi:91988750 |
| 1804: | DQ476823 | gi:91988988 | 1864: | DQ476763 | gi:91988868 | 1924: | DQ476703 | gi:91988748 |
| 1805: | DQ476822 | gi:91988986 | 1865: | DQ476762 | gi:91988866 | 1925: | DQ476702 | gi:91988746 |
| 1806: | DQ476821 | gi:91988984 | 1866: | DQ476761 | gi:91988864 | 1926: | DQ476701 | gi:91988744 |
| 1807: | DQ476820 | gi:91988982 | 1867: | DQ476760 | gi:91988862 | 1927: | DQ476700 | gi:91988742 |
| 1808: | DQ476819 | gi:91988980 | 1868: | DQ476759 | gi:91988860 | 1928: | DQ476699 | gi:91988740 |
| 1809: | DQ476818 | gi:91988978 | 1869: | DQ476758 | gi:91988858 | 1929: | DQ476698 | gi:91988738 |
| 1810: | DQ476817 | gi:91988976 | 1870: | DQ476757 | gi:91988856 | 1930: | DQ476697 | gi:91988736 |
| 1811: | DQ476816 | gi:91988974 | 1871: | DQ476756 | gi:91988854 | 1931: | DQ476696 | gi:91988734 |
| 1812: | DQ476815 | gi:91988972 | 1872: | DQ476755 | gi:91988852 | 1932: | DQ476695 | gi:91988732 |
| 1813: | DQ476814 | gi:91988970 | 1873: | DQ476754 | gi:91988850 | 1933: | DQ476694 | gi:91988730 |
| 1814: | DQ476813 | gi:91988968 | 1874: | DQ476753 | gi:91988848 | 1934: | DQ476693 | gi:91988728 |
| 1815: | DQ476812 | gi:91988966 | 1875: | DQ476752 | gi:91988846 | 1935: | DQ476692 | gi:91988726 |
| 1816: | DQ476811 | gi:91988964 | 1876: | DQ476751 | gi:91988844 | 1936: | DQ476691 | gi:91988724 |
| 1817: | DQ476810 | gi:91988962 | 1877: | DQ476750 | gi:91988842 | 1937: | DQ476690 | gi:91988722 |
| 1818: | DQ476809 | gi:91988960 | 1878: | DQ476749 | gi:91988840 | 1938: | DQ476689 | gi:91988720 |
| 1819: | DQ476808 | gi:91988958 | 1879: | DQ476748 | gi:91988838 | 1939: | DQ476688 | gi:91988718 |
| 1820: | DQ476807 | gi:91988956 | 1880: | DQ476747 | gi:91988836 | 1940: | DQ476687 | gi:91988716 |
| 1821: | DQ476806 | gi:91988954 | 1881: | DQ476746 | gi:91988834 | 1941: | DQ476686 | gi:91988714 |
| 1822: | DQ476805 | gi:91988952 | 1882: | DQ476745 | gi:91988832 | 1942: | DQ476685 | gi:91988712 |

FIG. 6 (con't)

| | | | | | | | | |
|---|---|---|---|---|---|---|---|---|
| 1823: | DQ476804 | gi:91988950 | 1883: | DQ476744 | gi:91988830 | 1943: | DQ476684 | gi:91988710 |
| 1824: | DQ476803 | gi:91988948 | 1884: | DQ476743 | gi:91988828 | 1944: | DQ476683 | gi:91988708 |
| 1825: | DQ476802 | gi:91988946 | 1885: | DQ476742 | gi:91988826 | 1945: | DQ476682 | gi:91988706 |
| 1826: | DQ476801 | gi:91988944 | 1886: | DQ476741 | gi:91988824 | 1946: | DQ476681 | gi:91988704 |
| 1827: | DQ476800 | gi:91988942 | 1887: | DQ476740 | gi:91988822 | 1947: | DQ476680 | gi:91988702 |
| 1828: | DQ476799 | gi:91988940 | 1888: | DQ476739 | gi:91988820 | 1948: | DQ476679 | gi:91988700 |
| 1829: | DQ476798 | gi:91988938 | 1889: | DQ476738 | gi:91988818 | 1949: | DQ476678 | gi:91988698 |
| 1830: | DQ476797 | gi:91988936 | 1890: | DQ476737 | gi:91988816 | 1950: | DQ476677 | gi:91988696 |
| 1831: | DQ476796 | gi:91988934 | 1891: | DQ476736 | gi:91988814 | 1951: | DQ476676 | gi:91988694 |
| 1832: | DQ476795 | gi:91988932 | 1892: | DQ476735 | gi:91988812 | 1952: | DQ476675 | gi:91988692 |
| 1833: | DQ476794 | gi:91988930 | 1893: | DQ476734 | gi:91988810 | 1953: | DQ476674 | gi:91988690 |
| 1834: | DQ476793 | gi:91988928 | 1894: | DQ476733 | gi:91988808 | 1954: | DQ476673 | gi:91988688 |
| 1835: | DQ476792 | gi:91988926 | 1895: | DQ476732 | gi:91988806 | 1955: | DQ476672 | gi:91988686 |
| 1836: | DQ476791 | gi:91988924 | 1896: | DQ476731 | gi:91988804 | 1956: | DQ476671 | gi:91988684 |
| 1837: | DQ476790 | gi:91988922 | 1897: | DQ476730 | gi:91988802 | 1957: | DQ476670 | gi:91988682 |
| 1838: | DQ476789 | gi:91988920 | 1898: | DQ476729 | gi:91988800 | 1958: | DQ476669 | gi:91988680 |
| 1839: | DQ476788 | gi:91988918 | 1899: | DQ476728 | gi:91988798 | 1959: | DQ476668 | gi:91988678 |
| 1840: | DQ476787 | gi:91988916 | 1900: | DQ476727 | gi:91988796 | 1960: | DQ476667 | gi:91988676 |
| 1841: | DQ476786 | gi:91988914 | 1901: | DQ476726 | gi:91988794 | 1961: | DQ476666 | gi:91988674 |
| 1842: | DQ476785 | gi:91988912 | 1902: | DQ476725 | gi:91988792 | 1962: | DQ476665 | gi:91988672 |
| 1843: | DQ476784 | gi:91988910 | 1903: | DQ476724 | gi:91988790 | 1963: | DQ476664 | gi:91988670 |
| 1844: | DQ476783 | gi:91988908 | 1904: | DQ476723 | gi:91988788 | 1964: | DQ476663 | gi:91988668 |
| 1845: | DQ476782 | gi:91988906 | 1905: | DQ476722 | gi:91988786 | 1965: | DQ476662 | gi:91988666 |
| 1846: | DQ476781 | gi:91988904 | 1906: | DQ476721 | gi:91988784 | 1966: | DQ476661 | gi:91988664 |
| 1847: | DQ476780 | gi:91988902 | 1907: | DQ476720 | gi:91988782 | 1967: | DQ476660 | gi:91988662 |
| 1848: | DQ476779 | gi:91988900 | 1908: | DQ476719 | gi:91988780 | 1968: | DQ476659 | gi:91988660 |
| 1849: | DQ476778 | gi:91988898 | 1909: | DQ476718 | gi:91988778 | 1969: | DQ476658 | gi:91988658 |
| 1850: | DQ476777 | gi:91988896 | 1910: | DQ476717 | gi:91988776 | 1970: | DQ476657 | gi:91988656 |
| 1851: | DQ476776 | gi:91988894 | 1911: | DQ476716 | gi:91988774 | 1971: | DQ476656 | gi:91988654 |
| 1852: | DQ476775 | gi:91988892 | 1912: | DQ476715 | gi:91988772 | 1972: | DQ476655 | gi:91988652 |
| 1853: | DQ476774 | gi:91988890 | 1913: | DQ476714 | gi:91988770 | 1973: | DQ476654 | gi:91988650 |
| 1854: | DQ476773 | gi:91988888 | 1914: | DQ476713 | gi:91988768 | 1974: | DQ476653 | gi:91988648 |
| 1855: | DQ476772 | gi:91988886 | 1915: | DQ476712 | gi:91988766 | 1975: | DQ476652 | gi:91988646 |
| 1856: | DQ476771 | gi:91988884 | 1916: | DQ476711 | gi:91988764 | 1976: | DQ476651 | gi:91988644 |
| 1857: | DQ476770 | gi:91988882 | 1917: | DQ476710 | gi:91988762 | 1977: | DQ476650 | gi:91988642 |
| 1858: | DQ476769 | gi:91988880 | 1918: | DQ476709 | gi:91988760 | 1978: | DQ476649 | gi:91988640 |
| 1859: | DQ476768 | gi:91988878 | 1919: | DQ476708 | gi:91988758 | 1979: | DQ476648 | gi:91988638 |
| 1860: | DQ476767 | gi:91988876 | 1920: | DQ476707 | gi:91988756 | 1980: | DQ476647 | gi:91988636 |

FIG. 6 (con't)

| Accession No. | | GI No. | Accession No. | | GI No. | Accession No. | | GI No. |
|---|---|---|---|---|---|---|---|---|
| 1981: | DQ476646 | gi:91988634 | 2041: | DQ476586 | gi:91988514 | 2101: | DQ476526 | gi:91988394 |
| 1982: | DQ476645 | gi:91988632 | 2042: | DQ476585 | gi:91988512 | 2102: | DQ476525 | gi:91988392 |
| 1983: | DQ476644 | gi:91988630 | 2043: | DQ476584 | gi:91988510 | 2103: | DQ476524 | gi:91988390 |
| 1984: | DQ476643 | gi:91988628 | 2044: | DQ476583 | gi:91988508 | 2104: | DQ476523 | gi:91988388 |
| 1985: | DQ476642 | gi:91988626 | 2045: | DQ476582 | gi:91988506 | 2105: | DQ476522 | gi:91988386 |
| 1986: | DQ476641 | gi:91988624 | 2046: | DQ476581 | gi:91988504 | 2106: | DQ476521 | gi:91988384 |
| 1987: | DQ476640 | gi:91988622 | 2047: | DQ476580 | gi:91988502 | 2107: | DQ476520 | gi:91988382 |
| 1988: | DQ476639 | gi:91988620 | 2048: | DQ476579 | gi:91988500 | 2108: | DQ476519 | gi:91988380 |
| 1989: | DQ476638 | gi:91988618 | 2049: | DQ476578 | gi:91988498 | 2109: | DQ476518 | gi:91988378 |
| 1990: | DQ476637 | gi:91988616 | 2050: | DQ476577 | gi:91988496 | 2110: | DQ476517 | gi:91988376 |
| 1991: | DQ476636 | gi:91988614 | 2051: | DQ476576 | gi:91988494 | 2111: | DQ476516 | gi:91988374 |
| 1992: | DQ476635 | gi:91988612 | 2052: | DQ476575 | gi:91988492 | 2112: | DQ476515 | gi:91988372 |
| 1993: | DQ476634 | gi:91988610 | 2053: | DQ476574 | gi:91988490 | 2113: | DQ476514 | gi:91988370 |
| 1994: | DQ476633 | gi:91988608 | 2054: | DQ476573 | gi:91988488 | 2114: | DQ476513 | gi:91988368 |
| 1995: | DQ476632 | gi:91988606 | 2055: | DQ476572 | gi:91988486 | 2115: | DQ476512 | gi:91988366 |
| 1996: | DQ476631 | gi:91988604 | 2056: | DQ476571 | gi:91988484 | 2116: | DQ476511 | gi:91988364 |
| 1997: | DQ476630 | gi:91988602 | 2057: | DQ476570 | gi:91988482 | 2117: | DQ476510 | gi:91988362 |
| 1998: | DQ476629 | gi:91988600 | 2058: | DQ476569 | gi:91988480 | 2118: | DQ476509 | gi:91988360 |
| 1999: | DQ476628 | gi:91988598 | 2059: | DQ476568 | gi:91988478 | 2119: | DQ476508 | gi:91988358 |
| 2000: | DQ476627 | gi:91988596 | 2060: | DQ476567 | gi:91988476 | 2120: | DQ476507 | gi:91988356 |
| 2001: | DQ476626 | gi:91988594 | 2061: | DQ476566 | gi:91988474 | 2121: | DQ476506 | gi:91988354 |
| 2002: | DQ476625 | gi:91988592 | 2062: | DQ476565 | gi:91988472 | 2122: | DQ476505 | gi:91988352 |
| 2003: | DQ476624 | gi:91988590 | 2063: | DQ476564 | gi:91988470 | 2123: | DQ476504 | gi:91988350 |
| 2004: | DQ476623 | gi:91988588 | 2064: | DQ476563 | gi:91988468 | 2124: | DQ476503 | gi:91988348 |
| 2005: | DQ476622 | gi:91988586 | 2065: | DQ476562 | gi:91988466 | 2125: | DQ476502 | gi:91988346 |
| 2006: | DQ476621 | gi:91988584 | 2066: | DQ476561 | gi:91988464 | 2126: | DQ476501 | gi:91988344 |
| 2007: | DQ476620 | gi:91988582 | 2067: | DQ476560 | gi:91988462 | 2127: | DQ476500 | gi:91988342 |
| 2008: | DQ476619 | gi:91988580 | 2068: | DQ476559 | gi:91988460 | 2128: | DQ476499 | gi:91988340 |
| 2009: | DQ476618 | gi:91988578 | 2069: | DQ476558 | gi:91988458 | 2129: | DQ476498 | gi:91988338 |
| 2010: | DQ476617 | gi:91988576 | 2070: | DQ476557 | gi:91988456 | 2130: | DQ476497 | gi:91988336 |
| 2011: | DQ476616 | gi:91988574 | 2071: | DQ476556 | gi:91988454 | 2131: | DQ476496 | gi:91988334 |
| 2012: | DQ476615 | gi:91988572 | 2072: | DQ476555 | gi:91988452 | 2132: | DQ476495 | gi:91988332 |
| 2013: | DQ476614 | gi:91988570 | 2073: | DQ476554 | gi:91988450 | 2133: | DQ476494 | gi:91988330 |
| 2014: | DQ476613 | gi:91988568 | 2074: | DQ476553 | gi:91988448 | 2134: | DQ476493 | gi:91988328 |
| 2015: | DQ476612 | gi:91988566 | 2075: | DQ476552 | gi:91988446 | 2135: | DQ476492 | gi:91988326 |
| 2016: | DQ476611 | gi:91988564 | 2076: | DQ476551 | gi:91988444 | 2136: | DQ476491 | gi:91988324 |

FIG. 6 (con't)

| | | | | | | | | |
|---|---|---|---|---|---|---|---|---|
| 2017: | DQ476610 | gi:91988562 | 2077: | DQ476550 | gi:91988442 | 2137: | DQ476490 | gi:91988322 |
| 2018: | DQ476609 | gi:91988560 | 2078: | DQ476549 | gi:91988440 | 2138: | DQ476489 | gi:91988320 |
| 2019: | DQ476608 | gi:91988558 | 2079: | DQ476548 | gi:91988438 | 2139: | DQ476488 | gi:91988318 |
| 2020: | DQ476607 | gi:91988556 | 2080: | DQ476547 | gi:91988436 | 2140: | DQ476487 | gi:91988316 |
| 2021: | DQ476606 | gi:91988554 | 2081: | DQ476546 | gi:91988434 | 2141: | DQ476486 | gi:91988314 |
| 2022: | DQ476605 | gi:91988552 | 2082: | DQ476545 | gi:91988432 | 2142: | DQ476485 | gi:91988312 |
| 2023: | DQ476604 | gi:91988550 | 2083: | DQ476544 | gi:91988430 | 2143: | DQ476484 | gi:91988310 |
| 2024: | DQ476603 | gi:91988548 | 2084: | DQ476543 | gi:91988428 | 2144: | DQ476483 | gi:91988308 |
| 2025: | DQ476602 | gi:91988546 | 2085: | DQ476542 | gi:91988426 | 2145: | DQ476482 | gi:91988306 |
| 2026: | DQ476601 | gi:91988544 | 2086: | DQ476541 | gi:91988424 | 2146: | DQ476481 | gi:91988304 |
| 2027: | DQ476600 | gi:91988542 | 2087: | DQ476540 | gi:91988422 | 2147: | DQ476480 | gi:91988302 |
| 2028: | DQ476599 | gi:91988540 | 2088: | DQ476539 | gi:91988420 | 2148: | DQ476479 | gi:91988300 |
| 2029: | DQ476598 | gi:91988538 | 2089: | DQ476538 | gi:91988418 | 2149: | DQ476478 | gi:91988298 |
| 2030: | DQ476597 | gi:91988536 | 2090: | DQ476537 | gi:91988416 | 2150: | DQ476477 | gi:91988296 |
| 2031: | DQ476596 | gi:91988534 | 2091: | DQ476536 | gi:91988414 | 2151: | DQ476476 | gi:91988294 |
| 2032: | DQ476595 | gi:91988532 | 2092: | DQ476535 | gi:91988412 | 2152: | DQ476475 | gi:91988292 |
| 2033: | DQ476594 | gi:91988530 | 2093: | DQ476534 | gi:91988410 | 2153: | DQ476474 | gi:91988290 |
| 2034: | DQ476593 | gi:91988528 | 2094: | DQ476533 | gi:91988408 | 2154: | DQ476473 | gi:91988288 |
| 2035: | DQ476592 | gi:91988526 | 2095: | DQ476532 | gi:91988406 | 2155: | DQ476472 | gi:91988286 |
| 2036: | DQ476591 | gi:91988524 | 2096: | DQ476531 | gi:91988404 | 2156: | DQ476471 | gi:91988284 |
| 2037: | DQ476590 | gi:91988522 | 2097: | DQ476530 | gi:91988402 | 2157: | DQ476470 | gi:91988282 |
| 2038: | DQ476589 | gi:91988520 | 2098: | DQ476529 | gi:91988400 | 2158: | DQ476469 | gi:91988280 |
| 2039: | DQ476588 | gi:91988518 | 2099: | DQ476528 | gi:91988398 | 2159: | DQ476468 | gi:91988278 |
| 2040: | DQ476587 | gi:91988516 | 2100: | DQ476527 | gi:91988396 | 2160: | DQ476467 | gi:91988276 |

| Accession No. | | GI No. | Accession No. | | GI No. | Accession No. | | GI No. |
|---|---|---|---|---|---|---|---|---|
| 2161: | DQ476466 | gi:91988274 | 2221: | DQ476406 | gi:91988154 | 2281: | DQ476346 | gi:91988034 |
| 2162: | DQ476465 | gi:91988272 | 2222: | DQ476405 | gi:91988152 | 2282: | DQ476345 | gi:91988032 |
| 2163: | DQ476464 | gi:91988270 | 2223: | DQ476404 | gi:91988150 | 2283: | DQ476344 | gi:91988030 |
| 2164: | DQ476463 | gi:91988268 | 2224: | DQ476403 | gi:91988148 | 2284: | DQ476343 | gi:91988028 |
| 2165: | DQ476462 | gi:91988266 | 2225: | DQ476402 | gi:91988146 | 2285: | DQ476342 | gi:91988026 |
| 2166: | DQ476461 | gi:91988264 | 2226: | DQ476401 | gi:91988144 | 2286: | DQ476341 | gi:91988024 |
| 2167: | DQ476460 | gi:91988262 | 2227: | DQ476400 | gi:91988142 | 2287: | DQ476340 | gi:91988022 |
| 2168: | DQ476459 | gi:91988260 | 2228: | DQ476399 | gi:91988140 | 2288: | DQ476339 | gi:91988020 |
| 2169: | DQ476458 | gi:91988258 | 2229: | DQ476398 | gi:91988138 | 2289: | DQ476338 | gi:91988018 |
| 2170: | DQ476457 | gi:91988256 | 2230: | DQ476397 | gi:91988136 | 2290: | DQ476337 | gi:91988016 |
| 2171: | DQ476456 | gi:91988254 | 2231: | DQ476396 | gi:91988134 | 2291: | DQ476336 | gi:91988014 |
| 2172: | DQ476455 | gi:91988252 | 2232: | DQ476395 | gi:91988132 | 2292: | DQ476335 | gi:91988012 |

FIG. 6 (con't)

| | | | | | | | | |
|---|---|---|---|---|---|---|---|---|
| 2173: | DQ476454 | gi:91988250 | 2233: | DQ476394 | gi:91988130 | 2293: | DQ476334 | gi:91988010 |
| 2174: | DQ476453 | gi:91988248 | 2234: | DQ476393 | gi:91988128 | 2294: | DQ476333 | gi:91988008 |
| 2175: | DQ476452 | gi:91988246 | 2235: | DQ476392 | gi:91988126 | 2295: | DQ476332 | gi:91988006 |
| 2176: | DQ476451 | gi:91988244 | 2236: | DQ476391 | gi:91988124 | 2296: | DQ476331 | gi:91988004 |
| 2177: | DQ476450 | gi:91988242 | 2237: | DQ476390 | gi:91988122 | 2297: | DQ476330 | gi:91988002 |
| 2178: | DQ476449 | gi:91988240 | 2238: | DQ476389 | gi:91988120 | 2298: | DQ476329 | gi:91988000 |
| 2179: | DQ476448 | gi:91988238 | 2239: | DQ476388 | gi:91988118 | 2299: | DQ476328 | gi:91987998 |
| 2180: | DQ476447 | gi:91988236 | 2240: | DQ476387 | gi:91988116 | 2300: | DQ476327 | gi:91987996 |
| 2181: | DQ476446 | gi:91988234 | 2241: | DQ476386 | gi:91988114 | 2301: | DQ476326 | gi:91987994 |
| 2182: | DQ476445 | gi:91988232 | 2242: | DQ476385 | gi:91988112 | 2302: | DQ476325 | gi:91987992 |
| 2183: | DQ476444 | gi:91988230 | 2243: | DQ476384 | gi:91988110 | 2303: | DQ476324 | gi:91987990 |
| 2184: | DQ476443 | gi:91988228 | 2244: | DQ476383 | gi:91988108 | 2304: | DQ476323 | gi:91987988 |
| 2185: | DQ476442 | gi:91988226 | 2245: | DQ476382 | gi:91988106 | 2305: | DQ476322 | gi:91987986 |
| 2186: | DQ476441 | gi:91988224 | 2246: | DQ476381 | gi:91988104 | 2306: | DQ476321 | gi:91987984 |
| 2187: | DQ476440 | gi:91988222 | 2247: | DQ476380 | gi:91988102 | 2307: | DQ476320 | gi:91987982 |
| 2188: | DQ476439 | gi:91988220 | 2248: | DQ476379 | gi:91988100 | 2308: | DQ476319 | gi:91987980 |
| 2189: | DQ476438 | gi:91988218 | 2249: | DQ476378 | gi:91988098 | 2309: | DQ476318 | gi:91987978 |
| 2190: | DQ476437 | gi:91988216 | 2250: | DQ476377 | gi:91988096 | 2310: | DQ476317 | gi:91987976 |
| 2191: | DQ476436 | gi:91988214 | 2251: | DQ476376 | gi:91988094 | 2311: | DQ476316 | gi:91987974 |
| 2192: | DQ476435 | gi:91988212 | 2252: | DQ476375 | gi:91988092 | 2312: | DQ476315 | gi:91987972 |
| 2193: | DQ476434 | gi:91988210 | 2253: | DQ476374 | gi:91988090 | 2313: | DQ476314 | gi:91987970 |
| 2194: | DQ476433 | gi:91988208 | 2254: | DQ476373 | gi:91988088 | 2314: | DQ476313 | gi:91987968 |
| 2195: | DQ476432 | gi:91988206 | 2255: | DQ476372 | gi:91988086 | 2315: | DQ476312 | gi:91987966 |
| 2196: | DQ476431 | gi:91988204 | 2256: | DQ476371 | gi:91988084 | 2316: | DQ476311 | gi:91987964 |
| 2197: | DQ476430 | gi:91988202 | 2257: | DQ476370 | gi:91988082 | 2317: | DQ476310 | gi:91987962 |
| 2198: | DQ476429 | gi:91988200 | 2258: | DQ476369 | gi:91988080 | 2318: | DQ476309 | gi:91987960 |
| 2199: | DQ476428 | gi:91988198 | 2259: | DQ476368 | gi:91988078 | 2319: | DQ476308 | gi:91987958 |
| 2200: | DQ476427 | gi:91988196 | 2260: | DQ476367 | gi:91988076 | 2320: | DQ476307 | gi:91987956 |
| 2201: | DQ476426 | gi:91988194 | 2261: | DQ476366 | gi:91988074 | 2321: | DQ476306 | gi:91987954 |
| 2202: | DQ476425 | gi:91988192 | 2262: | DQ476365 | gi:91988072 | 2322: | DQ476305 | gi:91987952 |
| 2203: | DQ476424 | gi:91988190 | 2263: | DQ476364 | gi:91988070 | 2323: | DQ476304 | gi:91987950 |
| 2204: | DQ476423 | gi:91988188 | 2264: | DQ476363 | gi:91988068 | 2324: | DQ476303 | gi:91987948 |
| 2205: | DQ476422 | gi:91988186 | 2265: | DQ476362 | gi:91988066 | 2325: | DQ476302 | gi:91987946 |
| 2206: | DQ476421 | gi:91988184 | 2266: | DQ476361 | gi:91988064 | 2326: | DQ476301 | gi:91987944 |
| 2207: | DQ476420 | gi:91988182 | 2267: | DQ476360 | gi:91988062 | 2327: | DQ476300 | gi:91987942 |
| 2208: | DQ476419 | gi:91988180 | 2268: | DQ476359 | gi:91988060 | 2328: | DQ476299 | gi:91987940 |
| 2209: | DQ476418 | gi:91988178 | 2269: | DQ476358 | gi:91988058 | 2329: | DQ476298 | gi:91987938 |
| 2210: | DQ476417 | gi:91988176 | 2270: | DQ476357 | gi:91988056 | 2330: | DQ476297 | gi:91987936 |

FIG. 6 (con't)

| | | | | | | | | |
|---|---|---|---|---|---|---|---|---|
| 2211: | DQ476416 | gi:91988174 | 2271: | DQ476356 | gi:91988054 | 2331: | DQ476296 | gi:91987934 |
| 2212: | DQ476415 | gi:91988172 | 2272: | DQ476355 | gi:91988052 | 2332: | DQ476295 | gi:91987932 |
| 2213: | DQ476414 | gi:91988170 | 2273: | DQ476354 | gi:91988050 | 2333: | DQ476294 | gi:91987930 |
| 2214: | DQ476413 | gi:91988168 | 2274: | DQ476353 | gi:91988048 | 2334: | DQ476293 | gi:91987928 |
| 2215: | DQ476412 | gi:91988166 | 2275: | DQ476352 | gi:91988046 | 2335: | DQ476292 | gi:91987926 |
| 2216: | DQ476411 | gi:91988164 | 2276: | DQ476351 | gi:91988044 | 2336: | DQ476291 | gi:91987924 |
| 2217: | DQ476410 | gi:91988162 | 2277: | DQ476350 | gi:91988042 | 2337: | DQ476290 | gi:91987922 |
| 2218: | DQ476409 | gi:91988160 | 2278: | DQ476349 | gi:91988040 | 2338: | DQ476289 | gi:91987920 |
| 2219: | DQ476408 | gi:91988158 | 2279: | DQ476348 | gi:91988038 | 2339: | DQ476288 | gi:91987918 |
| 2220: | DQ476407 | gi:91988156 | 2280: | DQ476347 | gi:91988036 | 2340: | DQ476287 | gi:91987916 |

| Accession No. | | GI No. | Accession No. | | GI No. | Accession No. | | GI No. |
|---|---|---|---|---|---|---|---|---|
| 2341: | DQ476286 | gi:91987914 | 2401: | DQ476226 | gi:91987794 | 2461: | DQ476166 | gi:91987674 |
| 2342: | DQ476285 | gi:91987912 | 2402: | DQ476225 | gi:91987792 | 2462: | DQ476165 | gi:91987672 |
| 2343: | DQ476284 | gi:91987910 | 2403: | DQ476224 | gi:91987790 | 2463: | DQ476164 | gi:91987670 |
| 2344: | DQ476283 | gi:91987908 | 2404: | DQ476223 | gi:91987788 | 2464: | DQ476163 | gi:91987668 |
| 2345: | DQ476282 | gi:91987906 | 2405: | DQ476222 | gi:91987786 | 2465: | DQ476162 | gi:91987666 |
| 2346: | DQ476281 | gi:91987904 | 2406: | DQ476221 | gi:91987784 | 2466: | DQ476161 | gi:91987664 |
| 2347: | DQ476280 | gi:91987902 | 2407: | DQ476220 | gi:91987782 | 2467: | DQ476160 | gi:91987662 |
| 2348: | DQ476279 | gi:91987900 | 2408: | DQ476219 | gi:91987780 | 2468: | DQ476159 | gi:91987660 |
| 2349: | DQ476278 | gi:91987898 | 2409: | DQ476218 | gi:91987778 | 2469: | DQ476158 | gi:91987658 |
| 2350: | DQ476277 | gi:91987896 | 2410: | DQ476217 | gi:91987776 | 2470: | DQ476157 | gi:91987656 |
| 2351: | DQ476276 | gi:91987894 | 2411: | DQ476216 | gi:91987774 | 2471: | DQ476156 | gi:91987654 |
| 2352: | DQ476275 | gi:91987892 | 2412: | DQ476215 | gi:91987772 | 2472: | DQ476155 | gi:91987652 |
| 2353: | DQ476274 | gi:91987890 | 2413: | DQ476214 | gi:91987770 | 2473: | DQ476154 | gi:91987650 |
| 2354: | DQ476273 | gi:91987888 | 2414: | DQ476213 | gi:91987768 | 2474: | DQ476153 | gi:91987648 |
| 2355: | DQ476272 | gi:91987886 | 2415: | DQ476212 | gi:91987766 | 2475: | DQ476152 | gi:91987646 |
| 2356: | DQ476271 | gi:91987884 | 2416: | DQ476211 | gi:91987764 | 2476: | DQ476151 | gi:91987644 |
| 2357: | DQ476270 | gi:91987882 | 2417: | DQ476210 | gi:91987762 | 2477: | DQ476150 | gi:91987642 |
| 2358: | DQ476269 | gi:91987880 | 2418: | DQ476209 | gi:91987760 | 2478: | DQ476149 | gi:91987640 |
| 2359: | DQ476268 | gi:91987878 | 2419: | DQ476208 | gi:91987758 | 2479: | DQ476148 | gi:91987638 |
| 2360: | DQ476267 | gi:91987876 | 2420: | DQ476207 | gi:91987756 | 2480: | DQ476147 | gi:91987636 |
| 2361: | DQ476266 | gi:91987874 | 2421: | DQ476206 | gi:91987754 | 2481: | DQ476146 | gi:91987634 |
| 2362: | DQ476265 | gi:91987872 | 2422: | DQ476205 | gi:91987752 | 2482: | DQ476145 | gi:91987632 |
| 2363: | DQ476264 | gi:91987870 | 2423: | DQ476204 | gi:91987750 | 2483: | DQ476144 | gi:91987630 |
| 2364: | DQ476263 | gi:91987868 | 2424: | DQ476203 | gi:91987748 | 2484: | DQ476143 | gi:91987628 |
| 2365: | DQ476262 | gi:91987866 | 2425: | DQ476202 | gi:91987746 | 2485: | DQ476142 | gi:91987626 |
| 2366: | DQ476261 | gi:91987864 | 2426: | DQ476201 | gi:91987744 | 2486: | DQ476141 | gi:91987624 |

FIG. 6 (con't)

| | | | | | | | | |
|---|---|---|---|---|---|---|---|---|
| 2367: | DQ476260 | gi:91987862 | 2427: | DQ476200 | gi:91987742 | 2487: | DQ476140 | gi:91987622 |
| 2368: | DQ476259 | gi:91987860 | 2428: | DQ476199 | gi:91987740 | 2488: | DQ476139 | gi:91987620 |
| 2369: | DQ476258 | gi:91987858 | 2429: | DQ476198 | gi:91987738 | 2489: | DQ476138 | gi:91987618 |
| 2370: | DQ476257 | gi:91987856 | 2430: | DQ476197 | gi:91987736 | 2490: | DQ476137 | gi:91987616 |
| 2371: | DQ476256 | gi:91987854 | 2431: | DQ476196 | gi:91987734 | 2491: | DQ476136 | gi:91987614 |
| 2372: | DQ476255 | gi:91987852 | 2432: | DQ476195 | gi:91987732 | 2492: | DQ476135 | gi:91987612 |
| 2373: | DQ476254 | gi:91987850 | 2433: | DQ476194 | gi:91987730 | 2493: | DQ476134 | gi:91987610 |
| 2374: | DQ476253 | gi:91987848 | 2434: | DQ476193 | gi:91987728 | 2494: | DQ476133 | gi:91987608 |
| 2375: | DQ476252 | gi:91987846 | 2435: | DQ476192 | gi:91987726 | 2495: | DQ476132 | gi:91987606 |
| 2376: | DQ476251 | gi:91987844 | 2436: | DQ476191 | gi:91987724 | 2496: | DQ476131 | gi:91987604 |
| 2377: | DQ476250 | gi:91987842 | 2437: | DQ476190 | gi:91987722 | 2497: | DQ476130 | gi:91987602 |
| 2378: | DQ476249 | gi:91987840 | 2438: | DQ476189 | gi:91987720 | 2498: | DQ476129 | gi:91987600 |
| 2379: | DQ476248 | gi:91987838 | 2439: | DQ476188 | gi:91987718 | 2499: | DQ476128 | gi:91987598 |
| 2380: | DQ476247 | gi:91987836 | 2440: | DQ476187 | gi:91987716 | 2500: | DQ476127 | gi:91987596 |
| 2381: | DQ476246 | gi:91987834 | 2441: | DQ476186 | gi:91987714 | 2501: | DQ476126 | gi:91987594 |
| 2382: | DQ476245 | gi:91987832 | 2442: | DQ476185 | gi:91987712 | 2502: | DQ476125 | gi:91987592 |
| 2383: | DQ476244 | gi:91987830 | 2443: | DQ476184 | gi:91987710 | 2503: | DQ476124 | gi:91987590 |
| 2384: | DQ476243 | gi:91987828 | 2444: | DQ476183 | gi:91987708 | 2504: | DQ476123 | gi:91987588 |
| 2385: | DQ476242 | gi:91987826 | 2445: | DQ476182 | gi:91987706 | 2505: | DQ476122 | gi:91987586 |
| 2386: | DQ476241 | gi:91987824 | 2446: | DQ476181 | gi:91987704 | 2506: | DQ476121 | gi:91987584 |
| 2387: | DQ476240 | gi:91987822 | 2447: | DQ476180 | gi:91987702 | 2507: | DQ476120 | gi:91987582 |
| 2388: | DQ476239 | gi:91987820 | 2448: | DQ476179 | gi:91987700 | 2508: | DQ476119 | gi:91987580 |
| 2389: | DQ476238 | gi:91987818 | 2449: | DQ476178 | gi:91987698 | 2509: | DQ476118 | gi:91987578 |
| 2390: | DQ476237 | gi:91987816 | 2450: | DQ476177 | gi:91987696 | 2510: | DQ476117 | gi:91987576 |
| 2391: | DQ476236 | gi:91987814 | 2451: | DQ476176 | gi:91987694 | 2511: | DQ476116 | gi:91987574 |
| 2392: | DQ476235 | gi:91987812 | 2452: | DQ476175 | gi:91987692 | 2512: | DQ476115 | gi:91987572 |
| 2393: | DQ476234 | gi:91987810 | 2453: | DQ476174 | gi:91987690 | 2513: | DQ476114 | gi:91987570 |
| 2394: | DQ476233 | gi:91987808 | 2454: | DQ476173 | gi:91987688 | 2514: | DQ476113 | gi:91987568 |
| 2395: | DQ476232 | gi:91987806 | 2455: | DQ476172 | gi:91987686 | 2515: | DQ476112 | gi:91987566 |
| 2396: | DQ476231 | gi:91987804 | 2456: | DQ476171 | gi:91987684 | 2516: | DQ476111 | gi:91987564 |
| 2397: | DQ476230 | gi:91987802 | 2457: | DQ476170 | gi:91987682 | 2517: | DQ476110 | gi:91987562 |
| 2398: | DQ476229 | gi:91987800 | 2458: | DQ476169 | gi:91987680 | 2518: | DQ476109 | gi:91987560 |
| 2399: | DQ476228 | gi:91987798 | 2459: | DQ476168 | gi:91987678 | 2519: | DQ476108 | gi:91987558 |
| 2400: | DQ476227 | gi:91987796 | 2460: | DQ476167 | gi:91987676 | 2520: | DQ476107 | gi:91987556 |

| Accession No. | | GI No. | Accession No. | | GI No. | Accession No. | | GI No. |
|---|---|---|---|---|---|---|---|---|
| 2521: | DQ476106 | gi:91987554 | 2581: | DQ476046 | gi:91987434 | 2641: | DQ475986 | gi:91987314 |
| 2522: | DQ476105 | gi:91987552 | 2582: | DQ476045 | gi:91987432 | 2642: | DQ475985 | gi:91987312 |

FIG. 6 (con't)

| | | | | | | | | |
|---|---|---|---|---|---|---|---|---|
| 2523: | DQ476104 | gi:91987550 | 2583: | DQ476044 | gi:91987430 | 2643: | DQ475984 | gi:91987310 |
| 2524: | DQ476103 | gi:91987548 | 2584: | DQ476043 | gi:91987428 | 2644: | DQ475983 | gi:91987308 |
| 2525: | DQ476102 | gi:91987546 | 2585: | DQ476042 | gi:91987426 | 2645: | DQ475982 | gi:91987306 |
| 2526: | DQ476101 | gi:91987544 | 2586: | DQ476041 | gi:91987424 | 2646: | DQ475981 | gi:91987304 |
| 2527: | DQ476100 | gi:91987542 | 2587: | DQ476040 | gi:91987422 | 2647: | DQ475980 | gi:91987302 |
| 2528: | DQ476099 | gi:91987540 | 2588: | DQ476039 | gi:91987420 | 2648: | DQ475979 | gi:91987300 |
| 2529: | DQ476098 | gi:91987538 | 2589: | DQ476038 | gi:91987418 | 2649: | DQ475978 | gi:91987298 |
| 2530: | DQ476097 | gi:91987536 | 2590: | DQ476037 | gi:91987416 | 2650: | DQ475977 | gi:91987296 |
| 2531: | DQ476096 | gi:91987534 | 2591: | DQ476036 | gi:91987414 | 2651: | DQ475976 | gi:91987294 |
| 2532: | DQ476095 | gi:91987532 | 2592: | DQ476035 | gi:91987412 | 2652: | DQ475975 | gi:91987292 |
| 2533: | DQ476094 | gi:91987530 | 2593: | DQ476034 | gi:91987410 | 2653: | DQ475974 | gi:91987290 |
| 2534: | DQ476093 | gi:91987528 | 2594: | DQ476033 | gi:91987408 | 2654: | DQ475973 | gi:91987288 |
| 2535: | DQ476092 | gi:91987526 | 2595: | DQ476032 | gi:91987406 | 2655: | DQ475972 | gi:91987286 |
| 2536: | DQ476091 | gi:91987524 | 2596: | DQ476031 | gi:91987404 | 2656: | DQ475971 | gi:91987284 |
| 2537: | DQ476090 | gi:91987522 | 2597: | DQ476030 | gi:91987402 | 2657: | DQ475970 | gi:91987282 |
| 2538: | DQ476089 | gi:91987520 | 2598: | DQ476029 | gi:91987400 | 2658: | DQ475969 | gi:91987280 |
| 2539: | DQ476088 | gi:91987518 | 2599: | DQ476028 | gi:91987398 | 2659: | DQ475968 | gi:91987278 |
| 2540: | DQ476087 | gi:91987516 | 2600: | DQ476027 | gi:91987396 | 2660: | DQ475967 | gi:91987276 |
| 2541: | DQ476086 | gi:91987514 | 2601: | DQ476026 | gi:91987394 | 2661: | DQ475966 | gi:91987274 |
| 2542: | DQ476085 | gi:91987512 | 2602: | DQ476025 | gi:91987392 | 2662: | DQ475965 | gi:91987272 |
| 2543: | DQ476084 | gi:91987510 | 2603: | DQ476024 | gi:91987390 | 2663: | DQ475964 | gi:91987270 |
| 2544: | DQ476083 | gi:91987508 | 2604: | DQ476023 | gi:91987388 | 2664: | DQ475963 | gi:91987268 |
| 2545: | DQ476082 | gi:91987506 | 2605: | DQ476022 | gi:91987386 | 2665: | DQ475962 | gi:91987266 |
| 2546: | DQ476081 | gi:91987504 | 2606: | DQ476021 | gi:91987384 | 2666: | DQ475961 | gi:91987264 |
| 2547: | DQ476080 | gi:91987502 | 2607: | DQ476020 | gi:91987382 | 2667: | DQ475960 | gi:91987262 |
| 2548: | DQ476079 | gi:91987500 | 2608: | DQ476019 | gi:91987380 | 2668: | DQ475959 | gi:91987260 |
| 2549: | DQ476078 | gi:91987498 | 2609: | DQ476018 | gi:91987378 | 2669: | DQ475958 | gi:91987258 |
| 2550: | DQ476077 | gi:91987496 | 2610: | DQ476017 | gi:91987376 | 2670: | DQ475957 | gi:91987256 |
| 2551: | DQ476076 | gi:91987494 | 2611: | DQ476016 | gi:91987374 | 2671: | DQ475956 | gi:91987254 |
| 2552: | DQ476075 | gi:91987492 | 2612: | DQ476015 | gi:91987372 | 2672: | DQ475955 | gi:91987252 |
| 2553: | DQ476074 | gi:91987490 | 2613: | DQ476014 | gi:91987370 | 2673: | DQ475954 | gi:91987250 |
| 2554: | DQ476073 | gi:91987488 | 2614: | DQ476013 | gi:91987368 | 2674: | DQ475953 | gi:91987248 |
| 2555: | DQ476072 | gi:91987486 | 2615: | DQ476012 | gi:91987366 | 2675: | DQ475952 | gi:91987246 |
| 2556: | DQ476071 | gi:91987484 | 2616: | DQ476011 | gi:91987364 | 2676: | DQ475951 | gi:91987244 |
| 2557: | DQ476070 | gi:91987482 | 2617: | DQ476010 | gi:91987362 | 2677: | DQ475950 | gi:91987242 |
| 2558: | DQ476069 | gi:91987480 | 2618: | DQ476009 | gi:91987360 | 2678: | DQ475949 | gi:91987240 |
| 2559: | DQ476068 | gi:91987478 | 2619: | DQ476008 | gi:91987358 | 2679: | DQ475948 | gi:91987238 |
| 2560: | DQ476067 | gi:91987476 | 2620: | DQ476007 | gi:91987356 | 2680: | DQ475947 | gi:91987236 |

FIG. 6 (con't)

| | | | | | | | | |
|---|---|---|---|---|---|---|---|---|
| 2561: | DQ476066 | gi:91987474 | 2621: | DQ476006 | gi:91987354 | 2681: | DQ475946 | gi:91987234 |
| 2562: | DQ476065 | gi:91987472 | 2622: | DQ476005 | gi:91987352 | 2682: | DQ475945 | gi:91987232 |
| 2563: | DQ476064 | gi:91987470 | 2623: | DQ476004 | gi:91987350 | 2683: | DQ475944 | gi:91987230 |
| 2564: | DQ476063 | gi:91987468 | 2624: | DQ476003 | gi:91987348 | 2684: | DQ475943 | gi:91987228 |
| 2565: | DQ476062 | gi:91987466 | 2625: | DQ476002 | gi:91987346 | 2685: | DQ475942 | gi:91987226 |
| 2566: | DQ476061 | gi:91987464 | 2626: | DQ476001 | gi:91987344 | 2686: | DQ475941 | gi:91987224 |
| 2567: | DQ476060 | gi:91987462 | 2627: | DQ476000 | gi:91987342 | 2687: | DQ475940 | gi:91987222 |
| 2568: | DQ476059 | gi:91987460 | 2628: | DQ475999 | gi:91987340 | 2688: | DQ475939 | gi:91987220 |
| 2569: | DQ476058 | gi:91987458 | 2629: | DQ475998 | gi:91987338 | 2689: | DQ475938 | gi:91987218 |
| 2570: | DQ476057 | gi:91987456 | 2630: | DQ475997 | gi:91987336 | 2690: | DQ475937 | gi:91987216 |
| 2571: | DQ476056 | gi:91987454 | 2631: | DQ475996 | gi:91987334 | 2691: | DQ475936 | gi:91987214 |
| 2572: | DQ476055 | gi:91987452 | 2632: | DQ475995 | gi:91987332 | 2692: | DQ475935 | gi:91987212 |
| 2573: | DQ476054 | gi:91987450 | 2633: | DQ475994 | gi:91987330 | 2693: | DQ475934 | gi:91987210 |
| 2574: | DQ476053 | gi:91987448 | 2634: | DQ475993 | gi:91987328 | 2694: | DQ475933 | gi:91987208 |
| 2575: | DQ476052 | gi:91987446 | 2635: | DQ475992 | gi:91987326 | 2695: | DQ475932 | gi:91987206 |
| 2576: | DQ476051 | gi:91987444 | 2636: | DQ475991 | gi:91987324 | 2696: | DQ475931 | gi:91987204 |
| 2577: | DQ476050 | gi:91987442 | 2637: | DQ475990 | gi:91987322 | 2697: | DQ475930 | gi:91987202 |
| 2578: | DQ476049 | gi:91987440 | 2638: | DQ475989 | gi:91987320 | 2698: | DQ475929 | gi:91987200 |
| 2579: | DQ476048 | gi:91987438 | 2639: | DQ475988 | gi:91987318 | 2699: | DQ475928 | gi:91987198 |
| 2580: | DQ476047 | gi:91987436 | 2640: | DQ475987 | gi:91987316 | 2700: | DQ475927 | gi:91987196 |

| Accession No. | | GI No. | Accession No. | | GI No. | Accession No. | | GI No. |
|---|---|---|---|---|---|---|---|---|
| 2701: | DQ475926 | gi:91987194 | 2761: | DQ475866 | gi:91987074 | 2821: | DQ475806 | gi:91986954 |
| 2702: | DQ475925 | gi:91987192 | 2762: | DQ475865 | gi:91987072 | 2822: | DQ475805 | gi:91986952 |
| 2703: | DQ475924 | gi:91987190 | 2763: | DQ475864 | gi:91987070 | 2823: | DQ475804 | gi:91986950 |
| 2704: | DQ475923 | gi:91987188 | 2764: | DQ475863 | gi:91987068 | 2824: | DQ475803 | gi:91986948 |
| 2705: | DQ475922 | gi:91987186 | 2765: | DQ475862 | gi:91987066 | 2825: | DQ475802 | gi:91986946 |
| 2706: | DQ475921 | gi:91987184 | 2766: | DQ475861 | gi:91987064 | 2826: | DQ475801 | gi:91986944 |
| 2707: | DQ475920 | gi:91987182 | 2767: | DQ475860 | gi:91987062 | 2827: | DQ475800 | gi:91986942 |
| 2708: | DQ475919 | gi:91987180 | 2768: | DQ475859 | gi:91987060 | 2828: | DQ475799 | gi:91986940 |
| 2709: | DQ475918 | gi:91987178 | 2769: | DQ475858 | gi:91987058 | 2829: | DQ475798 | gi:91986938 |
| 2710: | DQ475917 | gi:91987176 | 2770: | DQ475857 | gi:91987056 | 2830: | DQ475797 | gi:91986936 |
| 2711: | DQ475916 | gi:91987174 | 2771: | DQ475856 | gi:91987054 | 2831: | DQ475796 | gi:91986934 |
| 2712: | DQ475915 | gi:91987172 | 2772: | DQ475855 | gi:91987052 | 2832: | DQ475795 | gi:91986932 |
| 2713: | DQ475914 | gi:91987170 | 2773: | DQ475854 | gi:91987050 | 2833: | DQ475794 | gi:91986930 |
| 2714: | DQ475913 | gi:91987168 | 2774: | DQ475853 | gi:91987048 | 2834: | DQ475793 | gi:91986928 |
| 2715: | DQ475912 | gi:91987166 | 2775: | DQ475852 | gi:91987046 | 2835: | DQ475792 | gi:91986926 |
| 2716: | DQ475911 | gi:91987164 | 2776: | DQ475851 | gi:91987044 | 2836: | DQ475791 | gi:91986924 |

FIG. 6 (con't)

| | | | | | | | | |
|---|---|---|---|---|---|---|---|---|
| 2717: | DQ475910 | gi:91987162 | 2777: | DQ475850 | gi:91987042 | 2837: | DQ475790 | gi:91986922 |
| 2718: | DQ475909 | gi:91987160 | 2778: | DQ475849 | gi:91987040 | 2838: | DQ475789 | gi:91986920 |
| 2719: | DQ475908 | gi:91987158 | 2779: | DQ475848 | gi:91987038 | 2839: | DQ475788 | gi:91986918 |
| 2720: | DQ475907 | gi:91987156 | 2780: | DQ475847 | gi:91987036 | 2840: | DQ475787 | gi:91986916 |
| 2721: | DQ475906 | gi:91987154 | 2781: | DQ475846 | gi:91987034 | 2841: | DQ475786 | gi:91986914 |
| 2722: | DQ475905 | gi:91987152 | 2782: | DQ475845 | gi:91987032 | 2842: | DQ475785 | gi:91986912 |
| 2723: | DQ475904 | gi:91987150 | 2783: | DQ475844 | gi:91987030 | 2843: | DQ475784 | gi:91986910 |
| 2724: | DQ475903 | gi:91987148 | 2784: | DQ475843 | gi:91987028 | 2844: | DQ475783 | gi:91986908 |
| 2725: | DQ475902 | gi:91987146 | 2785: | DQ475842 | gi:91987026 | 2845: | DQ475782 | gi:91986906 |
| 2726: | DQ475901 | gi:91987144 | 2786: | DQ475841 | gi:91987024 | 2846: | DQ475781 | gi:91986904 |
| 2727: | DQ475900 | gi:91987142 | 2787: | DQ475840 | gi:91987022 | 2847: | DQ475780 | gi:91986902 |
| 2728: | DQ475899 | gi:91987140 | 2788: | DQ475839 | gi:91987020 | 2848: | DQ475779 | gi:91986900 |
| 2729: | DQ475898 | gi:91987138 | 2789: | DQ475838 | gi:91987018 | 2849: | DQ475778 | gi:91986898 |
| 2730: | DQ475897 | gi:91987136 | 2790: | DQ475837 | gi:91987016 | 2850: | DQ475777 | gi:91986896 |
| 2731: | DQ475896 | gi:91987134 | 2791: | DQ475836 | gi:91987014 | 2851: | DQ475776 | gi:91986894 |
| 2732: | DQ475895 | gi:91987132 | 2792: | DQ475835 | gi:91987012 | 2852: | DQ475775 | gi:91986892 |
| 2733: | DQ475894 | gi:91987130 | 2793: | DQ475834 | gi:91987010 | 2853: | DQ475774 | gi:91986890 |
| 2734: | DQ475893 | gi:91987128 | 2794: | DQ475833 | gi:91987008 | 2854: | DQ475773 | gi:91986888 |
| 2735: | DQ475892 | gi:91987126 | 2795: | DQ475832 | gi:91987006 | 2855: | DQ475772 | gi:91986886 |
| 2736: | DQ475891 | gi:91987124 | 2796: | DQ475831 | gi:91987004 | 2856: | DQ475771 | gi:91986884 |
| 2737: | DQ475890 | gi:91987122 | 2797: | DQ475830 | gi:91987002 | 2857: | DQ475770 | gi:91986882 |
| 2738: | DQ475889 | gi:91987120 | 2798: | DQ475829 | gi:91987000 | 2858: | DQ475769 | gi:91986880 |
| 2739: | DQ475888 | gi:91987118 | 2799: | DQ475828 | gi:91986998 | 2859: | DQ475768 | gi:91986878 |
| 2740: | DQ475887 | gi:91987116 | 2800: | DQ475827 | gi:91986996 | 2860: | DQ475767 | gi:91986876 |
| 2741: | DQ475886 | gi:91987114 | 2801: | DQ475826 | gi:91986994 | 2861: | DQ475766 | gi:91986874 |
| 2742: | DQ475885 | gi:91987112 | 2802: | DQ475825 | gi:91986992 | 2862: | DQ475765 | gi:91986872 |
| 2743: | DQ475884 | gi:91987110 | 2803: | DQ475824 | gi:91986990 | 2863: | DQ475764 | gi:91986870 |
| 2744: | DQ475883 | gi:91987108 | 2804: | DQ475823 | gi:91986988 | 2864: | DQ475763 | gi:91986868 |
| 2745: | DQ475882 | gi:91987106 | 2805: | DQ475822 | gi:91986986 | 2865: | DQ475762 | gi:91986866 |
| 2746: | DQ475881 | gi:91987104 | 2806: | DQ475821 | gi:91986984 | 2866: | DQ475761 | gi:91986864 |
| 2747: | DQ475880 | gi:91987102 | 2807: | DQ475820 | gi:91986982 | 2867: | DQ475760 | gi:91986862 |
| 2748: | DQ475879 | gi:91987100 | 2808: | DQ475819 | gi:91986980 | 2868: | DQ475759 | gi:91986860 |
| 2749: | DQ475878 | gi:91987098 | 2809: | DQ475818 | gi:91986978 | 2869: | DQ475758 | gi:91986858 |
| 2750: | DQ475877 | gi:91987096 | 2810: | DQ475817 | gi:91986976 | 2870: | DQ475757 | gi:91986856 |
| 2751: | DQ475876 | gi:91987094 | 2811: | DQ475816 | gi:91986974 | 2871: | DQ475756 | gi:91986854 |
| 2752: | DQ475875 | gi:91987092 | 2812: | DQ475815 | gi:91986972 | 2872: | DQ475755 | gi:91986852 |
| 2753: | DQ475874 | gi:91987090 | 2813: | DQ475814 | gi:91986970 | 2873: | DQ475754 | gi:91986850 |
| 2754: | DQ475873 | gi:91987088 | 2814: | DQ475813 | gi:91986968 | 2874: | DQ475753 | gi:91986848 |

FIG. 6 (con't)

| | | | | | | | | |
|---|---|---|---|---|---|---|---|---|
| 2755: | DQ475872 | gi:91987086 | 2815: | DQ475812 | gi:91986966 | 2875: | DQ475752 | gi:91986846 |
| 2756: | DQ475871 | gi:91987084 | 2816: | DQ475811 | gi:91986964 | 2876: | DQ475751 | gi:91986844 |
| 2757: | DQ475870 | gi:91987082 | 2817: | DQ475810 | gi:91986962 | 2877: | DQ475750 | gi:91986842 |
| 2758: | DQ475869 | gi:91987080 | 2818: | DQ475809 | gi:91986960 | 2878: | DQ475749 | gi:91986840 |
| 2759: | DQ475868 | gi:91987078 | 2819: | DQ475808 | gi:91986958 | 2879: | DQ475748 | gi:91986838 |
| 2760: | DQ475867 | gi:91987076 | 2820: | DQ475807 | gi:91986956 | 2880: | DQ475747 | gi:91986836 |

| Accession No. | | GI No. | Accession No. | | GI No. | Accession No. | | GI No. |
|---|---|---|---|---|---|---|---|---|
| 2881: | DQ475746 | gi:91986834 | 2941: | DQ475686 | gi:91986714 | 3001: | DQ475626 | gi:91986594 |
| 2882: | DQ475745 | gi:91986832 | 2942: | DQ475685 | gi:91986712 | 3002: | DQ475625 | gi:91986592 |
| 2883: | DQ475744 | gi:91986830 | 2943: | DQ475684 | gi:91986710 | 3003: | DQ475624 | gi:91986590 |
| 2884: | DQ475743 | gi:91986828 | 2944: | DQ475683 | gi:91986708 | 3004: | DQ475623 | gi:91986588 |
| 2885: | DQ475742 | gi:91986826 | 2945: | DQ475682 | gi:91986706 | 3005: | DQ475622 | gi:91986586 |
| 2886: | DQ475741 | gi:91986824 | 2946: | DQ475681 | gi:91986704 | 3006: | DQ475621 | gi:91986584 |
| 2887: | DQ475740 | gi:91986822 | 2947: | DQ475680 | gi:91986702 | 3007: | DQ475620 | gi:91986582 |
| 2888: | DQ475739 | gi:91986820 | 2948: | DQ475679 | gi:91986700 | 3008: | DQ475619 | gi:91986580 |
| 2889: | DQ475738 | gi:91986818 | 2949: | DQ475678 | gi:91986698 | 3009: | DQ475618 | gi:91986578 |
| 2890: | DQ475737 | gi:91986816 | 2950: | DQ475677 | gi:91986696 | 3010: | DQ475617 | gi:91986576 |
| 2891: | DQ475736 | gi:91986814 | 2951: | DQ475676 | gi:91986694 | 3011: | DQ475616 | gi:91986574 |
| 2892: | DQ475735 | gi:91986812 | 2952: | DQ475675 | gi:91986692 | 3012: | DQ475615 | gi:91986572 |
| 2893: | DQ475734 | gi:91986810 | 2953: | DQ475674 | gi:91986690 | 3013: | DQ475614 | gi:91986570 |
| 2894: | DQ475733 | gi:91986808 | 2954: | DQ475673 | gi:91986688 | 3014: | DQ475613 | gi:91986568 |
| 2895: | DQ475732 | gi:91986806 | 2955: | DQ475672 | gi:91986686 | 3015: | DQ475612 | gi:91986566 |
| 2896: | DQ475731 | gi:91986804 | 2956: | DQ475671 | gi:91986684 | 3016: | DQ475611 | gi:91986564 |
| 2897: | DQ475730 | gi:91986802 | 2957: | DQ475670 | gi:91986682 | 3017: | DQ475610 | gi:91986562 |
| 2898: | DQ475729 | gi:91986800 | 2958: | DQ475669 | gi:91986680 | 3018: | DQ475609 | gi:91986560 |
| 2899: | DQ475728 | gi:91986798 | 2959: | DQ475668 | gi:91986678 | 3019: | DQ475608 | gi:91986558 |
| 2900: | DQ475727 | gi:91986796 | 2960: | DQ475667 | gi:91986676 | 3020: | DQ475607 | gi:91986556 |
| 2901: | DQ475726 | gi:91986794 | 2961: | DQ475666 | gi:91986674 | 3021: | DQ475606 | gi:91986554 |
| 2902: | DQ475725 | gi:91986792 | 2962: | DQ475665 | gi:91986672 | 3022: | DQ475605 | gi:91986552 |
| 2903: | DQ475724 | gi:91986790 | 2963: | DQ475664 | gi:91986670 | 3023: | DQ475604 | gi:91986550 |
| 2904: | DQ475723 | gi:91986788 | 2964: | DQ475663 | gi:91986668 | 3024: | DQ475603 | gi:91986548 |
| 2905: | DQ475722 | gi:91986786 | 2965: | DQ475662 | gi:91986666 | 3025: | DQ475602 | gi:91986546 |
| 2906: | DQ475721 | gi:91986784 | 2966: | DQ475661 | gi:91986664 | 3026: | DQ475601 | gi:91986544 |
| 2907: | DQ475720 | gi:91986782 | 2967: | DQ475660 | gi:91986662 | 3027: | DQ475600 | gi:91986542 |
| 2908: | DQ475719 | gi:91986780 | 2968: | DQ475659 | gi:91986660 | 3028: | DQ475599 | gi:91986540 |
| 2909: | DQ475718 | gi:91986778 | 2969: | DQ475658 | gi:91986658 | 3029: | DQ475598 | gi:91986538 |
| 2910: | DQ475717 | gi:91986776 | 2970: | DQ475657 | gi:91986656 | 3030: | DQ475597 | gi:91986536 |

FIG. 6 (con't)

| | | | | | |
|---|---|---|---|---|---|
| 2911: DQ475716 | gi:91986774 | 2971: DQ475656 | gi:91986654 | 3031: DQ475596 | gi:91986534 |
| 2912: DQ475715 | gi:91986772 | 2972: DQ475655 | gi:91986652 | 3032: DQ475595 | gi:91986532 |
| 2913: DQ475714 | gi:91986770 | 2973: DQ475654 | gi:91986650 | 3033: DQ475594 | gi:91986530 |
| 2914: DQ475713 | gi:91986768 | 2974: DQ475653 | gi:91986648 | 3034: DQ475593 | gi:91986528 |
| 2915: DQ475712 | gi:91986766 | 2975: DQ475652 | gi:91986646 | 3035: DQ475592 | gi:91986526 |
| 2916: DQ475711 | gi:91986764 | 2976: DQ475651 | gi:91986644 | 3036: DQ475591 | gi:91986524 |
| 2917: DQ475710 | gi:91986762 | 2977: DQ475650 | gi:91986642 | 3037: DQ475590 | gi:91986522 |
| 2918: DQ475709 | gi:91986760 | 2978: DQ475649 | gi:91986640 | 3038: DQ475589 | gi:91986520 |
| 2919: DQ475708 | gi:91986758 | 2979: DQ475648 | gi:91986638 | 3039: DQ475588 | gi:91986518 |
| 2920: DQ475707 | gi:91986756 | 2980: DQ475647 | gi:91986636 | 3040: DQ475587 | gi:91986516 |
| 2921: DQ475706 | gi:91986754 | 2981: DQ475646 | gi:91986634 | 3041: DQ475586 | gi:91986514 |
| 2922: DQ475705 | gi:91986752 | 2982: DQ475645 | gi:91986632 | 3042: DQ475585 | gi:91986512 |
| 2923: DQ475704 | gi:91986750 | 2983: DQ475644 | gi:91986630 | 3043: DQ475584 | gi:91986510 |
| 2924: DQ475703 | gi:91986748 | 2984: DQ475643 | gi:91986628 | 3044: DQ475583 | gi:91986508 |
| 2925: DQ475702 | gi:91986746 | 2985: DQ475642 | gi:91986626 | 3045: DQ475582 | gi:91986506 |
| 2926: DQ475701 | gi:91986744 | 2986: DQ475641 | gi:91986624 | 3046: DQ475581 | gi:91986504 |
| 2927: DQ475700 | gi:91986742 | 2987: DQ475640 | gi:91986622 | 3047: DQ475580 | gi:91986502 |
| 2928: DQ475699 | gi:91986740 | 2988: DQ475639 | gi:91986620 | 3048: DQ475579 | gi:91986500 |
| 2929: DQ475698 | gi:91986738 | 2989: DQ475638 | gi:91986618 | 3049: DQ475578 | gi:91986498 |
| 2930: DQ475697 | gi:91986736 | 2990: DQ475637 | gi:91986616 | 3050: DQ475577 | gi:91986496 |
| 2931: DQ475696 | gi:91986734 | 2991: DQ475636 | gi:91986614 | 3051: DQ475576 | gi:91986494 |
| 2932: DQ475695 | gi:91986732 | 2992: DQ475635 | gi:91986612 | 3052: DQ475575 | gi:91986492 |
| 2933: DQ475694 | gi:91986730 | 2993: DQ475634 | gi:91986610 | 3053: DQ475574 | gi:91986490 |
| 2934: DQ475693 | gi:91986728 | 2994: DQ475633 | gi:91986608 | 3054: DQ475573 | gi:91986488 |
| 2935: DQ475692 | gi:91986726 | 2995: DQ475632 | gi:91986606 | 3055: DQ475572 | gi:91986486 |
| 2936: DQ475691 | gi:91986724 | 2996: DQ475631 | gi:91986604 | 3056: DQ475571 | gi:91986484 |
| 2937: DQ475690 | gi:91986722 | 2997: DQ475630 | gi:91986602 | 3057: DQ475570 | gi:91986482 |
| 2938: DQ475689 | gi:91986720 | 2998: DQ475629 | gi:91986600 | 3058: DQ475569 | gi:91986480 |
| 2939: DQ475688 | gi:91986718 | 2999: DQ475628 | gi:91986598 | 3059: DQ475568 | gi:91986478 |
| 2940: DQ475687 | gi:91986716 | 3000: DQ475627 | gi:91986596 | 3060: DQ475567 | gi:91986476 |

| Accession No. | GI No. | Accession No. | GI No. | Accession No. | GI No. |
|---|---|---|---|---|---|
| 3061: DQ475566 | gi:91986474 | 3121: DQ475506 | gi:91986354 | 3181: DQ475446 | gi:91986234 |
| 3062: DQ475565 | gi:91986472 | 3122: DQ475505 | gi:91986352 | 3182: DQ475445 | gi:91986232 |
| 3063: DQ475564 | gi:91986470 | 3123: DQ475504 | gi:91986350 | 3183: DQ475444 | gi:91986230 |
| 3064: DQ475563 | gi:91986468 | 3124: DQ475503 | gi:91986348 | 3184: DQ475443 | gi:91986228 |
| 3065: DQ475562 | gi:91986466 | 3125: DQ475502 | gi:91986346 | 3185: DQ475442 | gi:91986226 |
| 3066: DQ475561 | gi:91986464 | 3126: DQ475501 | gi:91986344 | 3186: DQ475441 | gi:91986224 |

FIG. 6 (con't)

| | | | | | | | | |
|---|---|---|---|---|---|---|---|---|
| 3067: | DQ475560 | gi:91986462 | 3127: | DQ475500 | gi:91986342 | 3187: | DQ475440 | gi:91986222 |
| 3068: | DQ475559 | gi:91986460 | 3128: | DQ475499 | gi:91986340 | 3188: | DQ475439 | gi:91986220 |
| 3069: | DQ475558 | gi:91986458 | 3129: | DQ475498 | gi:91986338 | 3189: | DQ475438 | gi:91986218 |
| 3070: | DQ475557 | gi:91986456 | 3130: | DQ475497 | gi:91986336 | 3190: | DQ475437 | gi:91986216 |
| 3071: | DQ475556 | gi:91986454 | 3131: | DQ475496 | gi:91986334 | 3191: | DQ475436 | gi:91986214 |
| 3072: | DQ475555 | gi:91986452 | 3132: | DQ475495 | gi:91986332 | 3192: | DQ475435 | gi:91986212 |
| 3073: | DQ475554 | gi:91986450 | 3133: | DQ475494 | gi:91986330 | 3193: | DQ475434 | gi:91986210 |
| 3074: | DQ475553 | gi:91986448 | 3134: | DQ475493 | gi:91986328 | 3194: | DQ475433 | gi:91986208 |
| 3075: | DQ475552 | gi:91986446 | 3135: | DQ475492 | gi:91986326 | 3195: | DQ475432 | gi:91986206 |
| 3076: | DQ475551 | gi:91986444 | 3136: | DQ475491 | gi:91986324 | 3196: | DQ475431 | gi:91986204 |
| 3077: | DQ475550 | gi:91986442 | 3137: | DQ475490 | gi:91986322 | 3197: | DQ475430 | gi:91986202 |
| 3078: | DQ475549 | gi:91986440 | 3138: | DQ475489 | gi:91986320 | 3198: | DQ475429 | gi:91986200 |
| 3079: | DQ475548 | gi:91986438 | 3139: | DQ475488 | gi:91986318 | 3199: | DQ475428 | gi:91986198 |
| 3080: | DQ475547 | gi:91986436 | 3140: | DQ475487 | gi:91986316 | 3200: | DQ475427 | gi:91986196 |
| 3081: | DQ475546 | gi:91986434 | 3141: | DQ475486 | gi:91986314 | 3201: | DQ475426 | gi:91986194 |
| 3082: | DQ475545 | gi:91986432 | 3142: | DQ475485 | gi:91986312 | 3202: | DQ475425 | gi:91986192 |
| 3083: | DQ475544 | gi:91986430 | 3143: | DQ475484 | gi:91986310 | 3203: | DQ475424 | gi:91986190 |
| 3084: | DQ475543 | gi:91986428 | 3144: | DQ475483 | gi:91986308 | 3204: | DQ475423 | gi:91986188 |
| 3085: | DQ475542 | gi:91986426 | 3145: | DQ475482 | gi:91986306 | 3205: | DQ475422 | gi:91986186 |
| 3086: | DQ475541 | gi:91986424 | 3146: | DQ475481 | gi:91986304 | 3206: | DQ475421 | gi:91986184 |
| 3087: | DQ475540 | gi:91986422 | 3147: | DQ475480 | gi:91986302 | 3207: | DQ475420 | gi:91986182 |
| 3088: | DQ475539 | gi:91986420 | 3148: | DQ475479 | gi:91986300 | 3208: | DQ475419 | gi:91986180 |
| 3089: | DQ475538 | gi:91986418 | 3149: | DQ475478 | gi:91986298 | 3209: | DQ475418 | gi:91986178 |
| 3090: | DQ475537 | gi:91986416 | 3150: | DQ475477 | gi:91986296 | 3210: | DQ475417 | gi:91986176 |
| 3091: | DQ475536 | gi:91986414 | 3151: | DQ475476 | gi:91986294 | 3211: | DQ475416 | gi:91986174 |
| 3092: | DQ475535 | gi:91986412 | 3152: | DQ475475 | gi:91986292 | 3212: | DQ475415 | gi:91986172 |
| 3093: | DQ475534 | gi:91986410 | 3153: | DQ475474 | gi:91986290 | 3213: | DQ475414 | gi:91986170 |
| 3094: | DQ475533 | gi:91986408 | 3154: | DQ475473 | gi:91986288 | 3214: | DQ475413 | gi:91986168 |
| 3095: | DQ475532 | gi:91986406 | 3155: | DQ475472 | gi:91986286 | 3215: | DQ475412 | gi:91986166 |
| 3096: | DQ475531 | gi:91986404 | 3156: | DQ475471 | gi:91986284 | 3216: | DQ475411 | gi:91986164 |
| 3097: | DQ475530 | gi:91986402 | 3157: | DQ475470 | gi:91986282 | 3217: | DQ475410 | gi:91986162 |
| 3098: | DQ475529 | gi:91986400 | 3158: | DQ475469 | gi:91986280 | 3218: | DQ475409 | gi:91986160 |
| 3099: | DQ475528 | gi:91986398 | 3159: | DQ475468 | gi:91986278 | 3219: | DQ475408 | gi:91986158 |
| 3100: | DQ475527 | gi:91986396 | 3160: | DQ475467 | gi:91986276 | 3220: | DQ475407 | gi:91986156 |
| 3101: | DQ475526 | gi:91986394 | 3161: | DQ475466 | gi:91986274 | 3221: | DQ475406 | gi:91986154 |
| 3102: | DQ475525 | gi:91986392 | 3162: | DQ475465 | gi:91986272 | 3222: | DQ475405 | gi:91986152 |
| 3103: | DQ475524 | gi:91986390 | 3163: | DQ475464 | gi:91986270 | 3223: | DQ475404 | gi:91986150 |
| 3104: | DQ475523 | gi:91986388 | 3164: | DQ475463 | gi:91986268 | 3224: | DQ475403 | gi:91986148 |

FIG. 6 (con't)

| | | | | | | | | |
|---|---|---|---|---|---|---|---|---|
| 3105: | DQ475522 | gi:91986386 | 3165: | DQ475462 | gi:91986266 | 3225: | DQ475402 | gi:91986146 |
| 3106: | DQ475521 | gi:91986384 | 3166: | DQ475461 | gi:91986264 | 3226: | DQ475401 | gi:91986144 |
| 3107: | DQ475520 | gi:91986382 | 3167: | DQ475460 | gi:91986262 | 3227: | DQ475400 | gi:91986142 |
| 3108: | DQ475519 | gi:91986380 | 3168: | DQ475459 | gi:91986260 | 3228: | DQ475399 | gi:91986140 |
| 3109: | DQ475518 | gi:91986378 | 3169: | DQ475458 | gi:91986258 | 3229: | DQ475398 | gi:91986138 |
| 3110: | DQ475517 | gi:91986376 | 3170: | DQ475457 | gi:91986256 | 3230: | DQ475397 | gi:91986136 |
| 3111: | DQ475516 | gi:91986374 | 3171: | DQ475456 | gi:91986254 | 3231: | DQ475396 | gi:91986134 |
| 3112: | DQ475515 | gi:91986372 | 3172: | DQ475455 | gi:91986252 | 3232: | DQ475395 | gi:91986132 |
| 3113: | DQ475514 | gi:91986370 | 3173: | DQ475454 | gi:91986250 | 3233: | DQ475394 | gi:91986130 |
| 3114: | DQ475513 | gi:91986368 | 3174: | DQ475453 | gi:91986248 | 3234: | DQ475393 | gi:91986128 |
| 3115: | DQ475512 | gi:91986366 | 3175: | DQ475452 | gi:91986246 | 3235: | DQ475392 | gi:91986126 |
| 3116: | DQ475511 | gi:91986364 | 3176: | DQ475451 | gi:91986244 | 3236: | DQ475391 | gi:91986124 |
| 3117: | DQ475510 | gi:91986362 | 3177: | DQ475450 | gi:91986242 | 3237: | DQ475390 | gi:91986122 |
| 3118: | DQ475509 | gi:91986360 | 3178: | DQ475449 | gi:91986240 | 3238: | DQ475389 | gi:91986120 |
| 3119: | DQ475508 | gi:91986358 | 3179: | DQ475448 | gi:91986238 | 3239: | DQ475388 | gi:91986118 |
| 3120: | DQ475507 | gi:91986356 | 3180: | DQ475447 | gi:91986236 | 3240: | DQ475387 | gi:91986116 |

| Accession No. | | GI No. | Accession No. | | GI No. | Accession No. | | GI No. |
|---|---|---|---|---|---|---|---|---|
| 3241: | DQ475386 | gi:91986114 | 3301: | DQ475326 | gi:91985994 | 3361: | DQ475266 | gi:91985874 |
| 3242: | DQ475385 | gi:91986112 | 3302: | DQ475325 | gi:91985992 | 3362: | DQ475265 | gi:91985872 |
| 3243: | DQ475384 | gi:91986110 | 3303: | DQ475324 | gi:91985990 | 3363: | DQ475264 | gi:91985870 |
| 3244: | DQ475383 | gi:91986108 | 3304: | DQ475323 | gi:91985988 | 3364: | DQ475263 | gi:91985868 |
| 3245: | DQ475382 | gi:91986106 | 3305: | DQ475322 | gi:91985986 | 3365: | DQ475262 | gi:91985866 |
| 3246: | DQ475381 | gi:91986104 | 3306: | DQ475321 | gi:91985984 | 3366: | DQ475261 | gi:91985864 |
| 3247: | DQ475380 | gi:91986102 | 3307: | DQ475320 | gi:91985982 | 3367: | DQ475260 | gi:91985862 |
| 3248: | DQ475379 | gi:91986100 | 3308: | DQ475319 | gi:91985980 | 3368: | DQ475259 | gi:91985860 |
| 3249: | DQ475378 | gi:91986098 | 3309: | DQ475318 | gi:91985978 | 3369: | DQ475258 | gi:91985858 |
| 3250: | DQ475377 | gi:91986096 | 3310: | DQ475317 | gi:91985976 | 3370: | DQ475257 | gi:91985856 |
| 3251: | DQ475376 | gi:91986094 | 3311: | DQ475316 | gi:91985974 | 3371: | DQ475256 | gi:91985854 |
| 3252: | DQ475375 | gi:91986092 | 3312: | DQ475315 | gi:91985972 | 3372: | DQ475255 | gi:91985852 |
| 3253: | DQ475374 | gi:91986090 | 3313: | DQ475314 | gi:91985970 | 3373: | DQ475254 | gi:91985850 |
| 3254: | DQ475373 | gi:91986088 | 3314: | DQ475313 | gi:91985968 | 3374: | DQ475253 | gi:91985848 |
| 3255: | DQ475372 | gi:91986086 | 3315: | DQ475312 | gi:91985966 | 3375: | DQ475252 | gi:91985846 |
| 3256: | DQ475371 | gi:91986084 | 3316: | DQ475311 | gi:91985964 | 3376: | DQ475251 | gi:91985844 |
| 3257: | DQ475370 | gi:91986082 | 3317: | DQ475310 | gi:91985962 | 3377: | DQ475250 | gi:91985842 |
| 3258: | DQ475369 | gi:91986080 | 3318: | DQ475309 | gi:91985960 | 3378: | DQ475249 | gi:91985840 |
| 3259: | DQ475368 | gi:91986078 | 3319: | DQ475308 | gi:91985958 | 3379: | DQ475248 | gi:91985838 |
| 3260: | DQ475367 | gi:91986076 | 3320: | DQ475307 | gi:91985956 | 3380: | DQ475247 | gi:91985836 |

FIG. 6 (con't)

| | | | | | | | | |
|---|---|---|---|---|---|---|---|---|
| 3261: | DQ475366 | gi:91986074 | 3321: | DQ475306 | gi:91985954 | 3381: | DQ475246 | gi:91985834 |
| 3262: | DQ475365 | gi:91986072 | 3322: | DQ475305 | gi:91985952 | 3382: | DQ475245 | gi:91985832 |
| 3263: | DQ475364 | gi:91986070 | 3323: | DQ475304 | gi:91985950 | 3383: | DQ475244 | gi:91985830 |
| 3264: | DQ475363 | gi:91986068 | 3324: | DQ475303 | gi:91985948 | 3384: | DQ475243 | gi:91985828 |
| 3265: | DQ475362 | gi:91986066 | 3325: | DQ475302 | gi:91985946 | 3385: | DQ475242 | gi:91985826 |
| 3266: | DQ475361 | gi:91986064 | 3326: | DQ475301 | gi:91985944 | 3386: | DQ475241 | gi:91985824 |
| 3267: | DQ475360 | gi:91986062 | 3327: | DQ475300 | gi:91985942 | 3387: | DQ475240 | gi:91985822 |
| 3268: | DQ475359 | gi:91986060 | 3328: | DQ475299 | gi:91985940 | 3388: | DQ475239 | gi:91985820 |
| 3269: | DQ475358 | gi:91986058 | 3329: | DQ475298 | gi:91985938 | 3389: | DQ475238 | gi:91985818 |
| 3270: | DQ475357 | gi:91986056 | 3330: | DQ475297 | gi:91985936 | 3390: | DQ475237 | gi:91985816 |
| 3271: | DQ475356 | gi:91986054 | 3331: | DQ475296 | gi:91985934 | 3391: | DQ475236 | gi:91985814 |
| 3272: | DQ475355 | gi:91986052 | 3332: | DQ475295 | gi:91985932 | 3392: | DQ475235 | gi:91985812 |
| 3273: | DQ475354 | gi:91986050 | 3333: | DQ475294 | gi:91985930 | 3393: | DQ475234 | gi:91985810 |
| 3274: | DQ475353 | gi:91986048 | 3334: | DQ475293 | gi:91985928 | 3394: | DQ475233 | gi:91985808 |
| 3275: | DQ475352 | gi:91986046 | 3335: | DQ475292 | gi:91985926 | 3395: | DQ475232 | gi:91985806 |
| 3276: | DQ475351 | gi:91986044 | 3336: | DQ475291 | gi:91985924 | 3396: | DQ475231 | gi:91985804 |
| 3277: | DQ475350 | gi:91986042 | 3337: | DQ475290 | gi:91985922 | 3397: | DQ475230 | gi:91985802 |
| 3278: | DQ475349 | gi:91986040 | 3338: | DQ475289 | gi:91985920 | 3398: | DQ475229 | gi:91985800 |
| 3279: | DQ475348 | gi:91986038 | 3339: | DQ475288 | gi:91985918 | 3399: | DQ475228 | gi:91985798 |
| 3280: | DQ475347 | gi:91986036 | 3340: | DQ475287 | gi:91985916 | 3400: | DQ475227 | gi:91985796 |
| 3281: | DQ475346 | gi:91986034 | 3341: | DQ475286 | gi:91985914 | 3401: | DQ475226 | gi:91985794 |
| 3282: | DQ475345 | gi:91986032 | 3342: | DQ475285 | gi:91985912 | 3402: | DQ475225 | gi:91985792 |
| 3283: | DQ475344 | gi:91986030 | 3343: | DQ475284 | gi:91985910 | 3403: | DQ475224 | gi:91985790 |
| 3284: | DQ475343 | gi:91986028 | 3344: | DQ475283 | gi:91985908 | 3404: | DQ475223 | gi:91985788 |
| 3285: | DQ475342 | gi:91986026 | 3345: | DQ475282 | gi:91985906 | 3405: | DQ475222 | gi:91985786 |
| 3286: | DQ475341 | gi:91986024 | 3346: | DQ475281 | gi:91985904 | 3406: | DQ475221 | gi:91985784 |
| 3287: | DQ475340 | gi:91986022 | 3347: | DQ475280 | gi:91985902 | 3407: | DQ475220 | gi:91985782 |
| 3288: | DQ475339 | gi:91986020 | 3348: | DQ475279 | gi:91985900 | 3408: | DQ475219 | gi:91985780 |
| 3289: | DQ475338 | gi:91986018 | 3349: | DQ475278 | gi:91985898 | 3409: | DQ475218 | gi:91985778 |
| 3290: | DQ475337 | gi:91986016 | 3350: | DQ475277 | gi:91985896 | 3410: | DQ475217 | gi:91985776 |
| 3291: | DQ475336 | gi:91986014 | 3351: | DQ475276 | gi:91985894 | 3411: | DQ475216 | gi:91985774 |
| 3292: | DQ475335 | gi:91986012 | 3352: | DQ475275 | gi:91985892 | 3412: | DQ475215 | gi:91985772 |
| 3293: | DQ475334 | gi:91986010 | 3353: | DQ475274 | gi:91985890 | 3413: | DQ475214 | gi:91985770 |
| 3294: | DQ475333 | gi:91986008 | 3354: | DQ475273 | gi:91985888 | 3414: | DQ475213 | gi:91985768 |
| 3295: | DQ475332 | gi:91986006 | 3355: | DQ475272 | gi:91985886 | 3415: | DQ475212 | gi:91985766 |
| 3296: | DQ475331 | gi:91986004 | 3356: | DQ475271 | gi:91985884 | 3416: | DQ475211 | gi:91985764 |
| 3297: | DQ475330 | gi:91986002 | 3357: | DQ475270 | gi:91985882 | 3417: | DQ475210 | gi:91985762 |
| 3298: | DQ475329 | gi:91986000 | 3358: | DQ475269 | gi:91985880 | 3418: | DQ475209 | gi:91985760 |

FIG. 6 (con't)

| | | | | | | | | |
|---|---|---|---|---|---|---|---|---|
| 3299: | DQ475328 | gi:91985998 | 3359: | DQ475268 | gi:91985878 | 3419: | DQ475208 | gi:91985758 |
| 3300: | DQ475327 | gi:91985996 | 3360: | DQ475267 | gi:91985876 | 3420: | DQ475207 | gi:91985756 |

| Accession No. | | GI No. | Accession No. | | GI No. | Accession No. | | GI No. |
|---|---|---|---|---|---|---|---|---|
| 3421: | DQ475206 | gi:91985754 | 3481: | DQ475146 | gi:91985634 | 3541: | DQ475086 | gi:91985514 |
| 3422: | DQ475205 | gi:91985752 | 3482: | DQ475145 | gi:91985632 | 3542: | DQ475085 | gi:91985512 |
| 3423: | DQ475204 | gi:91985750 | 3483: | DQ475144 | gi:91985630 | 3543: | DQ475084 | gi:91985510 |
| 3424: | DQ475203 | gi:91985748 | 3484: | DQ475143 | gi:91985628 | 3544: | DQ475083 | gi:91985508 |
| 3425: | DQ475202 | gi:91985746 | 3485: | DQ475142 | gi:91985626 | 3545: | DQ475082 | gi:91985506 |
| 3426: | DQ475201 | gi:91985744 | 3486: | DQ475141 | gi:91985624 | 3546: | DQ475081 | gi:91985504 |
| 3427: | DQ475200 | gi:91985742 | 3487: | DQ475140 | gi:91985622 | 3547: | DQ475080 | gi:91985502 |
| 3428: | DQ475199 | gi:91985740 | 3488: | DQ475139 | gi:91985620 | 3548: | DQ475079 | gi:91985500 |
| 3429: | DQ475198 | gi:91985738 | 3489: | DQ475138 | gi:91985618 | 3549: | DQ475078 | gi:91985498 |
| 3430: | DQ475197 | gi:91985736 | 3490: | DQ475137 | gi:91985616 | 3550: | DQ475077 | gi:91985496 |
| 3431: | DQ475196 | gi:91985734 | 3491: | DQ475136 | gi:91985614 | 3551: | DQ475076 | gi:91985494 |
| 3432: | DQ475195 | gi:91985732 | 3492: | DQ475135 | gi:91985612 | 3552: | DQ475075 | gi:91985492 |
| 3433: | DQ475194 | gi:91985730 | 3493: | DQ475134 | gi:91985610 | 3553: | DQ475074 | gi:91985490 |
| 3434: | DQ475193 | gi:91985728 | 3494: | DQ475133 | gi:91985608 | 3554: | DQ475073 | gi:91985488 |
| 3435: | DQ475192 | gi:91985726 | 3495: | DQ475132 | gi:91985606 | 3555: | DQ475072 | gi:91985486 |
| 3436: | DQ475191 | gi:91985724 | 3496: | DQ475131 | gi:91985604 | 3556: | DQ475071 | gi:91985484 |
| 3437: | DQ475190 | gi:91985722 | 3497: | DQ475130 | gi:91985602 | 3557: | DQ475070 | gi:91985482 |
| 3438: | DQ475189 | gi:91985720 | 3498: | DQ475129 | gi:91985600 | 3558: | DQ475069 | gi:91985480 |
| 3439: | DQ475188 | gi:91985718 | 3499: | DQ475128 | gi:91985598 | 3559: | DQ475068 | gi:91985478 |
| 3440: | DQ475187 | gi:91985716 | 3500: | DQ475127 | gi:91985596 | 3560: | DQ475067 | gi:91985476 |
| 3441: | DQ475186 | gi:91985714 | 3501: | DQ475126 | gi:91985594 | 3561: | DQ475066 | gi:91985474 |
| 3442: | DQ475185 | gi:91985712 | 3502: | DQ475125 | gi:91985592 | 3562: | DQ475065 | gi:91985472 |
| 3443: | DQ475184 | gi:91985710 | 3503: | DQ475124 | gi:91985590 | 3563: | DQ475064 | gi:91985470 |
| 3444: | DQ475183 | gi:91985708 | 3504: | DQ475123 | gi:91985588 | 3564: | DQ475063 | gi:91985468 |
| 3445: | DQ475182 | gi:91985706 | 3505: | DQ475122 | gi:91985586 | 3565: | DQ475062 | gi:91985466 |
| 3446: | DQ475181 | gi:91985704 | 3506: | DQ475121 | gi:91985584 | 3566: | DQ475061 | gi:91985464 |
| 3447: | DQ475180 | gi:91985702 | 3507: | DQ475120 | gi:91985582 | 3567: | DQ475060 | gi:91985462 |
| 3448: | DQ475179 | gi:91985700 | 3508: | DQ475119 | gi:91985580 | 3568: | DQ475059 | gi:91985460 |
| 3449: | DQ475178 | gi:91985698 | 3509: | DQ475118 | gi:91985578 | 3569: | DQ475058 | gi:91985458 |
| 3450: | DQ475177 | gi:91985696 | 3510: | DQ475117 | gi:91985576 | 3570: | DQ475057 | gi:91985456 |
| 3451: | DQ475176 | gi:91985694 | 3511: | DQ475116 | gi:91985574 | 3571: | DQ475056 | gi:91985454 |
| 3452: | DQ475175 | gi:91985692 | 3512: | DQ475115 | gi:91985572 | 3572: | DQ475055 | gi:91985452 |
| 3453: | DQ475174 | gi:91985690 | 3513: | DQ475114 | gi:91985570 | 3573: | DQ475054 | gi:91985450 |
| 3454: | DQ475173 | gi:91985688 | 3514: | DQ475113 | gi:91985568 | 3574: | DQ475053 | gi:91985448 |

FIG. 6 (con't)

| | | | | | | | | |
|---|---|---|---|---|---|---|---|---|
| 3455: | DQ475172 | gi:91985686 | 3515: | DQ475112 | gi:91985566 | 3575: | DQ475052 | gi:91985446 |
| 3456: | DQ475171 | gi:91985684 | 3516: | DQ475111 | gi:91985564 | 3576: | DQ475051 | gi:91985444 |
| 3457: | DQ475170 | gi:91985682 | 3517: | DQ475110 | gi:91985562 | 3577: | DQ475050 | gi:91985442 |
| 3458: | DQ475169 | gi:91985680 | 3518: | DQ475109 | gi:91985560 | 3578: | DQ475049 | gi:91985440 |
| 3459: | DQ475168 | gi:91985678 | 3519: | DQ475108 | gi:91985558 | 3579: | DQ475048 | gi:91985438 |
| 3460: | DQ475167 | gi:91985676 | 3520: | DQ475107 | gi:91985556 | 3580: | DQ475047 | gi:91985436 |
| 3461: | DQ475166 | gi:91985674 | 3521: | DQ475106 | gi:91985554 | 3581: | DQ475046 | gi:91985434 |
| 3462: | DQ475165 | gi:91985672 | 3522: | DQ475105 | gi:91985552 | 3582: | DQ475045 | gi:91985432 |
| 3463: | DQ475164 | gi:91985670 | 3523: | DQ475104 | gi:91985550 | 3583: | DQ475044 | gi:91985430 |
| 3464: | DQ475163 | gi:91985668 | 3524: | DQ475103 | gi:91985548 | 3584: | DQ475043 | gi:91985428 |
| 3465: | DQ475162 | gi:91985666 | 3525: | DQ475102 | gi:91985546 | 3585: | DQ475042 | gi:91985426 |
| 3466: | DQ475161 | gi:91985664 | 3526: | DQ475101 | gi:91985544 | 3586: | DQ475041 | gi:91985424 |
| 3467: | DQ475160 | gi:91985662 | 3527: | DQ475100 | gi:91985542 | 3587: | DQ475040 | gi:91985422 |
| 3468: | DQ475159 | gi:91985660 | 3528: | DQ475099 | gi:91985540 | 3588: | DQ475039 | gi:91985420 |
| 3469: | DQ475158 | gi:91985658 | 3529: | DQ475098 | gi:91985538 | 3589: | DQ475038 | gi:91985418 |
| 3470: | DQ475157 | gi:91985656 | 3530: | DQ475097 | gi:91985536 | 3590: | DQ475037 | gi:91985416 |
| 3471: | DQ475156 | gi:91985654 | 3531: | DQ475096 | gi:91985534 | 3591: | DQ475036 | gi:91985414 |
| 3472: | DQ475155 | gi:91985652 | 3532: | DQ475095 | gi:91985532 | 3592: | DQ475035 | gi:91985412 |
| 3473: | DQ475154 | gi:91985650 | 3533: | DQ475094 | gi:91985530 | 3593: | DQ475034 | gi:91985410 |
| 3474: | DQ475153 | gi:91985648 | 3534: | DQ475093 | gi:91985528 | 3594: | DQ475033 | gi:91985408 |
| 3475: | DQ475152 | gi:91985646 | 3535: | DQ475092 | gi:91985526 | 3595: | DQ475032 | gi:91985406 |
| 3476: | DQ475151 | gi:91985644 | 3536: | DQ475091 | gi:91985524 | 3596: | DQ475031 | gi:91985404 |
| 3477: | DQ475150 | gi:91985642 | 3537: | DQ475090 | gi:91985522 | 3597: | DQ475030 | gi:91985402 |
| 3478: | DQ475149 | gi:91985640 | 3538: | DQ475089 | gi:91985520 | 3598: | DQ475029 | gi:91985400 |
| 3479: | DQ475148 | gi:91985638 | 3539: | DQ475088 | gi:91985518 | 3599: | DQ475028 | gi:91985398 |
| 3480: | DQ475147 | gi:91985636 | 3540: | DQ475087 | gi:91985516 | 3600: | DQ475027 | gi:91985396 |

| Accession No. | | GI No. | Accession No. | | GI No. | Accession No. | | GI No. |
|---|---|---|---|---|---|---|---|---|
| 3601: | DQ475026 | gi:91985394 | 3661: | DQ474966 | gi:91985274 | 3721: | DQ474906 | gi:91985154 |
| 3602: | DQ475025 | gi:91985392 | 3662: | DQ474965 | gi:91985272 | 3722: | DQ474905 | gi:91985152 |
| 3603: | DQ475024 | gi:91985390 | 3663: | DQ474964 | gi:91985270 | 3723: | DQ474904 | gi:91985150 |
| 3604: | DQ475023 | gi:91985388 | 3664: | DQ474963 | gi:91985268 | 3724: | DQ474903 | gi:91985148 |
| 3605: | DQ475022 | gi:91985386 | 3665: | DQ474962 | gi:91985266 | 3725: | DQ474902 | gi:91985146 |
| 3606: | DQ475021 | gi:91985384 | 3666: | DQ474961 | gi:91985264 | 3726: | DQ474901 | gi:91985144 |
| 3607: | DQ475020 | gi:91985382 | 3667: | DQ474960 | gi:91985262 | 3727: | DQ474900 | gi:91985142 |
| 3608: | DQ475019 | gi:91985380 | 3668: | DQ474959 | gi:91985260 | 3728: | DQ474899 | gi:91985140 |
| 3609: | DQ475018 | gi:91985378 | 3669: | DQ474958 | gi:91985258 | 3729: | DQ474898 | gi:91985138 |
| 3610: | DQ475017 | gi:91985376 | 3670: | DQ474957 | gi:91985256 | 3730: | DQ474897 | gi:91985136 |

FIG. 6 (con't)

| | | | | | | | | |
|---|---|---|---|---|---|---|---|---|
| 3611: | DQ475016 | gi:91985374 | 3671: | DQ474956 | gi:91985254 | 3731: | DQ474896 | gi:91985134 |
| 3612: | DQ475015 | gi:91985372 | 3672: | DQ474955 | gi:91985252 | 3732: | DQ474895 | gi:91985132 |
| 3613: | DQ475014 | gi:91985370 | 3673: | DQ474954 | gi:91985250 | 3733: | DQ474894 | gi:91985130 |
| 3614: | DQ475013 | gi:91985368 | 3674: | DQ474953 | gi:91985248 | 3734: | DQ474893 | gi:91985128 |
| 3615: | DQ475012 | gi:91985366 | 3675: | DQ474952 | gi:91985246 | 3735: | DQ474892 | gi:91985126 |
| 3616: | DQ475011 | gi:91985364 | 3676: | DQ474951 | gi:91985244 | 3736: | DQ474891 | gi:91985124 |
| 3617: | DQ475010 | gi:91985362 | 3677: | DQ474950 | gi:91985242 | 3737: | DQ474890 | gi:91985122 |
| 3618: | DQ475009 | gi:91985360 | 3678: | DQ474949 | gi:91985240 | 3738: | DQ474889 | gi:91985120 |
| 3619: | DQ475008 | gi:91985358 | 3679: | DQ474948 | gi:91985238 | 3739: | DQ474888 | gi:91985118 |
| 3620: | DQ475007 | gi:91985356 | 3680: | DQ474947 | gi:91985236 | 3740: | DQ474887 | gi:91985116 |
| 3621: | DQ475006 | gi:91985354 | 3681: | DQ474946 | gi:91985234 | 3741: | DQ474886 | gi:91985114 |
| 3622: | DQ475005 | gi:91985352 | 3682: | DQ474945 | gi:91985232 | 3742: | DQ474885 | gi:91985112 |
| 3623: | DQ475004 | gi:91985350 | 3683: | DQ474944 | gi:91985230 | 3743: | DQ474884 | gi:91985110 |
| 3624: | DQ475003 | gi:91985348 | 3684: | DQ474943 | gi:91985228 | 3744: | DQ474883 | gi:91985108 |
| 3625: | DQ475002 | gi:91985346 | 3685: | DQ474942 | gi:91985226 | 3745: | DQ474882 | gi:91985106 |
| 3626: | DQ475001 | gi:91985344 | 3686: | DQ474941 | gi:91985224 | 3746: | DQ474881 | gi:91985104 |
| 3627: | DQ475000 | gi:91985342 | 3687: | DQ474940 | gi:91985222 | 3747: | DQ474880 | gi:91985102 |
| 3628: | DQ474999 | gi:91985340 | 3688: | DQ474939 | gi:91985220 | 3748: | DQ474879 | gi:91985100 |
| 3629: | DQ474998 | gi:91985338 | 3689: | DQ474938 | gi:91985218 | 3749: | DQ474878 | gi:91985098 |
| 3630: | DQ474997 | gi:91985336 | 3690: | DQ474937 | gi:91985216 | 3750: | DQ474877 | gi:91985096 |
| 3631: | DQ474996 | gi:91985334 | 3691: | DQ474936 | gi:91985214 | 3751: | DQ474876 | gi:91985094 |
| 3632: | DQ474995 | gi:91985332 | 3692: | DQ474935 | gi:91985212 | 3752: | DQ474875 | gi:91985092 |
| 3633: | DQ474994 | gi:91985330 | 3693: | DQ474934 | gi:91985210 | 3753: | DQ474874 | gi:91985090 |
| 3634: | DQ474993 | gi:91985328 | 3694: | DQ474933 | gi:91985208 | 3754: | DQ474873 | gi:91985088 |
| 3635: | DQ474992 | gi:91985326 | 3695: | DQ474932 | gi:91985206 | 3755: | DQ474872 | gi:91985086 |
| 3636: | DQ474991 | gi:91985324 | 3696: | DQ474931 | gi:91985204 | 3756: | DQ474871 | gi:91985084 |
| 3637: | DQ474990 | gi:91985322 | 3697: | DQ474930 | gi:91985202 | 3757: | DQ474870 | gi:91985082 |
| 3638: | DQ474989 | gi:91985320 | 3698: | DQ474929 | gi:91985200 | 3758: | DQ474869 | gi:91985080 |
| 3639: | DQ474988 | gi:91985318 | 3699: | DQ474928 | gi:91985198 | 3759: | DQ474868 | gi:91985078 |
| 3640: | DQ474987 | gi:91985316 | 3700: | DQ474927 | gi:91985196 | 3760: | DQ474867 | gi:91985076 |
| 3641: | DQ474986 | gi:91985314 | 3701: | DQ474926 | gi:91985194 | 3761: | DQ474866 | gi:91985074 |
| 3642: | DQ474985 | gi:91985312 | 3702: | DQ474925 | gi:91985192 | 3762: | DQ474865 | gi:91985072 |
| 3643: | DQ474984 | gi:91985310 | 3703: | DQ474924 | gi:91985190 | 3763: | DQ474864 | gi:91985070 |
| 3644: | DQ474983 | gi:91985308 | 3704: | DQ474923 | gi:91985188 | 3764: | DQ474863 | gi:91985068 |
| 3645: | DQ474982 | gi:91985306 | 3705: | DQ474922 | gi:91985186 | 3765: | DQ474862 | gi:91985066 |
| 3646: | DQ474981 | gi:91985304 | 3706: | DQ474921 | gi:91985184 | 3766: | DQ474861 | gi:91985064 |
| 3647: | DQ474980 | gi:91985302 | 3707: | DQ474920 | gi:91985182 | 3767: | DQ474860 | gi:91985062 |
| 3648: | DQ474979 | gi:91985300 | 3708: | DQ474919 | gi:91985180 | 3768: | DQ474859 | gi:91985060 |

FIG. 6 (con't)

| | | | | | | | | |
|---|---|---|---|---|---|---|---|---|
| 3649: | DQ474978 | gi:91985298 | 3709: | DQ474918 | gi:91985178 | 3769: | DQ474858 | gi:91985058 |
| 3650: | DQ474977 | gi:91985296 | 3710: | DQ474917 | gi:91985176 | 3770: | DQ474857 | gi:91985056 |
| 3651: | DQ474976 | gi:91985294 | 3711: | DQ474916 | gi:91985174 | 3771: | DQ474856 | gi:91985054 |
| 3652: | DQ474975 | gi:91985292 | 3712: | DQ474915 | gi:91985172 | 3772: | DQ474855 | gi:91985052 |
| 3653: | DQ474974 | gi:91985290 | 3713: | DQ474914 | gi:91985170 | 3773: | DQ474854 | gi:91985050 |
| 3654: | DQ474973 | gi:91985288 | 3714: | DQ474913 | gi:91985168 | 3774: | DQ474853 | gi:91985048 |
| 3655: | DQ474972 | gi:91985286 | 3715: | DQ474912 | gi:91985166 | 3775: | DQ474852 | gi:91985046 |
| 3656: | DQ474971 | gi:91985284 | 3716: | DQ474911 | gi:91985164 | 3776: | DQ474851 | gi:91985044 |
| 3657: | DQ474970 | gi:91985282 | 3717: | DQ474910 | gi:91985162 | 3777: | DQ474850 | gi:91985042 |
| 3658: | DQ474969 | gi:91985280 | 3718: | DQ474909 | gi:91985160 | 3778: | DQ474849 | gi:91985040 |
| 3659: | DQ474968 | gi:91985278 | 3719: | DQ474908 | gi:91985158 | 3779: | DQ474848 | gi:91985038 |
| 3660: | DQ474967 | gi:91985276 | 3720: | DQ474907 | gi:91985156 | 3780: | DQ474847 | gi:91985036 |

| Accession No. | | GI No. | Accession No. | | GI No. | Accession No. | | GI No. |
|---|---|---|---|---|---|---|---|---|
| 3781: | DQ474846 | gi:91985034 | 3841: | DQ474786 | gi:91984914 | 3901: | DQ009642 | gi:63109209 |
| 3782: | DQ474845 | gi:91985032 | 3842: | DQ474785 | gi:91984912 | 3902: | DQ009641 | gi:63109207 |
| 3783: | DQ474844 | gi:91985030 | 3843: | DQ474784 | gi:91984910 | 3903: | DQ009640 | gi:63109205 |
| 3784: | DQ474843 | gi:91985028 | 3844: | DQ474783 | gi:91984908 | 3904: | DQ009639 | gi:63109203 |
| 3785: | DQ474842 | gi:91985026 | 3845: | DQ474782 | gi:91984906 | 3905: | DQ009638 | gi:63109202 |
| 3786: | DQ474841 | gi:91985024 | 3846: | DQ474781 | gi:91984904 | 3906: | DQ009637 | gi:63109201 |
| 3787: | DQ474840 | gi:91985022 | 3847: | DQ474780 | gi:91984902 | 3907: | DQ009636 | gi:63109200 |
| 3788: | DQ474839 | gi:91985020 | 3848: | DQ474779 | gi:91984900 | 3908: | DQ009635 | gi:63109198 |
| 3789: | DQ474838 | gi:91985018 | 3849: | DQ474778 | gi:91984898 | 3909: | DQ009634 | gi:63109196 |
| 3790: | DQ474837 | gi:91985016 | 3850: | DQ474777 | gi:91984896 | 3910: | DQ009633 | gi:63109194 |
| 3791: | DQ474836 | gi:91985014 | 3851: | DQ474776 | gi:91984894 | 3911: | DQ009632 | gi:63109192 |
| 3792: | DQ474835 | gi:91985012 | 3852: | DQ474775 | gi:91984892 | 3912: | DQ009631 | gi:63109190 |
| 3793: | DQ474834 | gi:91985010 | 3853: | DQ474774 | gi:91984890 | 3913: | DQ009630 | gi:63109188 |
| 3794: | DQ474833 | gi:91985008 | 3854: | DQ474773 | gi:91984888 | 3914: | DQ009629 | gi:63109186 |
| 3795: | DQ474832 | gi:91985006 | 3855: | DQ474772 | gi:91984886 | 3915: | DQ009628 | gi:63109184 |
| 3796: | DQ474831 | gi:91985004 | 3856: | DQ474771 | gi:91984884 | 3916: | DQ009627 | gi:63109182 |
| 3797: | DQ474830 | gi:91985002 | 3857: | DQ474770 | gi:91984882 | 3917: | DQ009626 | gi:63109180 |
| 3798: | DQ474829 | gi:91985000 | 3858: | DQ474769 | gi:91984880 | 3918: | DQ009625 | gi:63109178 |
| 3799: | DQ474828 | gi:91984998 | 3859: | DQ474768 | gi:91984878 | 3919: | AY612613 | gi:51980219 |
| 3800: | DQ474827 | gi:91984996 | 3860: | DQ474767 | gi:91984876 | 3920: | DQ250084 | gi:80975834 |
| 3801: | DQ474826 | gi:91984994 | 3861: | DQ474766 | gi:91984874 | 3921: | DQ250083 | gi:80975832 |
| 3802: | DQ474825 | gi:91984992 | 3862: | DQ474765 | gi:91984872 | 3922: | DQ250082 | gi:80975830 |
| 3803: | DQ474824 | gi:91984990 | 3863: | DQ474764 | gi:91984870 | 3923: | DQ250081 | gi:80975828 |
| 3804: | DQ474823 | gi:91984988 | 3864: | DQ474763 | gi:91984868 | 3924: | DQ250080 | gi:80975826 |

FIG. 6 (con't)

| | | | | | | | | |
|---|---|---|---|---|---|---|---|---|
| 3805: | DQ474822 | gi:91984986 | 3865: | DQ474762 | gi:91984866 | 3925: | DQ250079 | gi:80975824 |
| 3806: | DQ474821 | gi:91984984 | 3866: | DQ474761 | gi:91984864 | 3926: | DQ250078 | gi:80975822 |
| 3807: | DQ474820 | gi:91984982 | 3867: | DQ459471 | gi:92090664 | 3927: | DQ250077 | gi:80975820 |
| 3808: | DQ474819 | gi:91984980 | 3868: | D45852 | gi:1089787 | 3928: | DQ250076 | gi:80975818 |
| 3809: | DQ474818 | gi:91984978 | 3869: | DQ379480 | gi:87047661 | 3929: | DQ250075 | gi:80975816 |
| 3810: | DQ474817 | gi:91984976 | 3870: | DQ379479 | gi:87047659 | 3930: | DQ250074 | gi:80975814 |
| 3811: | DQ474816 | gi:91984974 | 3871: | DQ355821 | gi:86161657 | 3931: | DQ250073 | gi:80975812 |
| 3812: | DQ474815 | gi:91984972 | 3872: | DQ355796 | gi:86129863 | 3932: | DQ250072 | gi:80975810 |
| 3813: | DQ474814 | gi:91984970 | 3873: | AF495521 | gi:20257587 | 3933: | DQ250071 | gi:80975808 |
| 3814: | DQ474813 | gi:91984968 | 3874: | AF495520 | gi:20257585 | 3934: | DQ250070 | gi:80975806 |
| 3815: | DQ474812 | gi:91984966 | 3875: | AF495519 | gi:20257583 | 3935: | DQ250069 | gi:80975804 |
| 3816: | DQ474811 | gi:91984964 | 3876: | AF495518 | gi:20257581 | 3936: | DQ246451 | gi:78711811 |
| 3817: | DQ474810 | gi:91984962 | 3877: | AF495517 | gi:20257579 | 3937: | AB175725 | gi:78183485 |
| 3818: | DQ474809 | gi:91984960 | 3878: | AF495516 | gi:20257577 | 3938: | AB175724 | gi:78183483 |
| 3819: | DQ474808 | gi:91984958 | 3879: | AF495515 | gi:20257575 | 3939: | AB175723 | gi:78183481 |
| 3820: | DQ474807 | gi:91984956 | 3880: | AF495514 | gi:20257573 | 3940: | AB175722 | gi:78183479 |
| 3821: | DQ474806 | gi:91984954 | 3881: | AF495513 | gi:20257571 | 3941: | AB175721 | gi:78183477 |
| 3822: | DQ474805 | gi:91984952 | 3882: | AF495512 | gi:20257569 | 3942: | AB175720 | gi:78183475 |
| 3823: | DQ474804 | gi:91984950 | 3883: | AF495511 | gi:20257567 | 3943: | AB175717 | gi:78183473 |
| 3824: | DQ474803 | gi:91984948 | 3884: | AF495510 | gi:20257565 | 3944: | AB175716 | gi:78183471 |
| 3825: | DQ474802 | gi:91984946 | 3885: | AF495509 | gi:20257563 | 3945: | AB175715 | gi:78183469 |
| 3826: | DQ474801 | gi:91984944 | 3886: | AF495508 | gi:20257561 | 3946: | AB175714 | gi:78183467 |
| 3827: | DQ474800 | gi:91984942 | 3887: | AF495507 | gi:20257559 | 3947: | AB175713 | gi:78183465 |
| 3828: | DQ474799 | gi:91984940 | 3888: | AF495506 | gi:20257557 | 3948: | AB175712 | gi:78183463 |
| 3829: | DQ474798 | gi:91984938 | 3889: | AF495505 | gi:20257555 | 3949: | AB175710 | gi:78183461 |
| 3830: | DQ474797 | gi:91984936 | 3890: | AF495504 | gi:20257553 | 3950: | AB175709 | gi:78183459 |
| 3831: | DQ474796 | gi:91984934 | 3891: | AF495503 | gi:20257551 | 3951: | AB175708 | gi:78183457 |
| 3832: | DQ474795 | gi:91984932 | 3892: | AF495502 | gi:20257549 | 3952: | AB175705 | gi:78183455 |
| 3833: | DQ474794 | gi:91984930 | 3893: | AF495501 | gi:20257547 | 3953: | AB175704 | gi:78183453 |
| 3834: | DQ474793 | gi:91984928 | 3894: | AF495500 | gi:20257545 | 3954: | AB175702 | gi:78183451 |
| 3835: | DQ474792 | gi:91984926 | 3895: | AF495499 | gi:20257543 | 3955: | AB175701 | gi:78183449 |
| 3836: | DQ474791 | gi:91984924 | 3896: | DQ009647 | gi:63109218 | 3956: | AB175700 | gi:78183447 |
| 3837: | DQ474790 | gi:91984922 | 3897: | DQ009646 | gi:63109216 | 3957: | AB175699 | gi:78183445 |
| 3838: | DQ474789 | gi:91984920 | 3898: | DQ009645 | gi:63109215 | 3958: | AB175698 | gi:78183443 |
| 3839: | DQ474788 | gi:91984918 | 3899: | DQ009644 | gi:63109213 | 3959: | AB175697 | gi:78183441 |
| 3840: | DQ474787 | gi:91984916 | 3900: | DQ009643 | gi:63109211 | 3960: | AB175696 | gi:78183439 |
| | Accession No. | GI No. | | Accession No. | GI No. | | Accession No. | GI No. |

FIG. 6 (con't)

| | | | | | | | | |
|---|---|---|---|---|---|---|---|---|
| 3961: | AB175695 | gi:78183437 | 4021: | AY633974 | gi:50428994 | 4081: | AF486480 | gi:28453836 |
| 3962: | AB175694 | gi:78183435 | 4022: | AY633973 | gi:50428992 | 4082: | AF486479 | gi:28453834 |
| 3963: | AB175693 | gi:78183433 | 4023: | AY585241 | gi:46519708 | 4083: | AF486478 | gi:28453832 |
| 3964: | AB175692 | gi:78183431 | 4024: | AY545985 | gi:45360239 | 4084: | AF486477 | gi:28453830 |
| 3965: | AB175691 | gi:78183429 | 4025: | AY297124 | gi:31746140 | 4085: | AF486476 | gi:28453828 |
| 3966: | AB175690 | gi:78183427 | 4026: | AY297123 | gi:31746138 | 4086: | AF486475 | gi:28453826 |
| 3967: | AY749411 | gi:58701157 | 4027: | AY297122 | gi:31746136 | 4087: | AF486474 | gi:28453824 |
| 3968: | AY749397 | gi:58701129 | 4028: | AY297121 | gi:31746134 | 4088: | AF486473 | gi:28453822 |
| 3969: | AY749393 | gi:58701121 | 4029: | AY297120 | gi:31746132 | 4089: | AF486472 | gi:28453820 |
| 3970: | AY749389 | gi:58701113 | 4030: | AY297119 | gi:31746130 | 4090: | AF486471 | gi:28453818 |
| 3971: | AY749385 | gi:58701105 | 4031: | AY297118 | gi:31746128 | 4091: | AF486470 | gi:28453816 |
| 3972: | AY749381 | gi:58701097 | 4032: | AY297117 | gi:31746126 | 4092: | AF486469 | gi:28453814 |
| 3973: | AY749377 | gi:58701089 | 4033: | AY297116 | gi:31746124 | 4093: | AF486468 | gi:28453812 |
| 3974: | AY875862 | gi:62085667 | 4034: | AY297115 | gi:31746122 | 4094: | AF486467 | gi:28453810 |
| 3975: | AY875861 | gi:62085665 | 4035: | AY297114 | gi:31746120 | 4095: | AF486466 | gi:28453808 |
| 3976: | AY875860 | gi:62085663 | 4036: | AY297113 | gi:31746118 | 4096: | AF486465 | gi:28453806 |
| 3977: | AY875859 | gi:62085661 | 4037: | AY297112 | gi:31746116 | 4097: | AF486464 | gi:28453804 |
| 3978: | AY875858 | gi:62085659 | 4038: | AY297111 | gi:31746114 | 4098: | AF486463 | gi:28453802 |
| 3979: | AY875857 | gi:62085657 | 4039: | AY613349 | gi:47834511 | 4099: | AF486462 | gi:28453800 |
| 3980: | AY875856 | gi:62085655 | 4040: | AY613348 | gi:47834509 | 4100: | AF486461 | gi:28453798 |
| 3981: | AY875855 | gi:62085653 | 4041: | AY422809 | gi:40287910 | 4101: | AF486460 | gi:28453796 |
| 3982: | AY875854 | gi:62085651 | 4042: | AY422808 | gi:40287908 | 4102: | AF486459 | gi:28453794 |
| 3983: | AY875853 | gi:62085649 | 4043: | AY422807 | gi:40287906 | 4103: | AF486458 | gi:28453792 |
| 3984: | AY641474 | gi:56462569 | 4044: | AY422806 | gi:40287904 | 4104: | AF486457 | gi:28453790 |
| 3985: | AY641473 | gi:56462567 | 4045: | AY422805 | gi:40287902 | 4105: | AF486456 | gi:28453788 |
| 3986: | AY615796 | gi:50235160 | 4046: | AY422804 | gi:40287900 | 4106: | AF486455 | gi:28453786 |
| 3987: | AY615795 | gi:50235158 | 4047: | AY422803 | gi:40287898 | 4107: | AF486454 | gi:28453784 |
| 3988: | AY615794 | gi:50235156 | 4048: | AY422802 | gi:40287896 | 4108: | AF486453 | gi:28453782 |
| 3989: | AY615793 | gi:50235154 | 4049: | AY422801 | gi:40287894 | 4109: | AF486452 | gi:28453780 |
| 3990: | AY615792 | gi:50235152 | 4050: | AY422800 | gi:40287892 | 4110: | AF535152 | gi:22655549 |
| 3991: | AY615791 | gi:50235150 | 4051: | AY422799 | gi:40287890 | 4111: | AF378820 | gi:22854636 |
| 3992: | AY615790 | gi:50235148 | 4052: | AY422798 | gi:40287888 | 4112: | AF378819 | gi:22854634 |
| 3993: | AY615789 | gi:50235146 | 4053: | AY395078 | gi:40795892 | 4113: | AF378818 | gi:22854632 |
| 3994: | AY615788 | gi:50235144 | 4054: | AY395077 | gi:40795890 | 4114: | AF378817 | gi:22854630 |
| 3995: | AY615787 | gi:50235142 | 4055: | AY395076 | gi:40795888 | 4115: | AF378816 | gi:22854628 |
| 3996: | AY615786 | gi:50235140 | 4056: | AY395075 | gi:40795886 | 4116: | AF378815 | gi:22854626 |
| 3997: | DQ056373 | gi:66735372 | 4057: | AY395074 | gi:40795884 | 4117: | AF378814 | gi:22854624 |
| 3998: | AF066183 | gi:66735498 | 4058: | AY395081 | gi:39980583 | 4118: | AF378813 | gi:22854622 |

FIG. 6 (con't)

| | | | | | | | | |
|---|---|---|---|---|---|---|---|---|
| 3999: | AY881994 | gi:60280505 | 4059: | AY395080 | gi:39980575 | 4119: | AF378812 | gi:22854620 |
| 4000: | AY754345 | gi:58760948 | 4060: | AY395079 | gi:39980567 | 4120: | AF378811 | gi:22854618 |
| 4001: | AY858586 | gi:57634599 | 4061: | AY366525 | gi:38146324 | 4121: | AF378810 | gi:22854616 |
| 4002: | AY858585 | gi:57634595 | 4062: | AY424271 | gi:40646796 | 4122: | AF378809 | gi:22854614 |
| 4003: | AY857637 | gi:57470955 | 4063: | AY513611 | gi:40950571 | 4123: | AF378808 | gi:22854612 |
| 4004: | AY857636 | gi:57470951 | 4064: | AY318774 | gi:37961314 | 4124: | AF378807 | gi:22854610 |
| 4005: | AY857635 | gi:57470947 | 4065: | AY318773 | gi:37961312 | 4125: | AF378806 | gi:22854608 |
| 4006: | AY656993 | gi:56111965 | 4066: | AY318772 | gi:37961310 | 4126: | AF378805 | gi:22854606 |
| 4007: | AY656992 | gi:56111963 | 4067: | AY318771 | gi:37961308 | 4127: | AF378804 | gi:22854604 |
| 4008: | AY656991 | gi:56111961 | 4068: | AY318770 | gi:37961306 | 4128: | AF378803 | gi:22854602 |
| 4009: | AY656990 | gi:56111959 | 4069: | AY318769 | gi:37961304 | 4129: | AF378802 | gi:22854600 |
| 4010: | AY656989 | gi:56111957 | 4070: | AY318768 | gi:37961302 | 4130: | AF378801 | gi:22854598 |
| 4011: | AY262352 | gi:31747018 | 4071: | AY318767 | gi:37961300 | 4131: | AF378800 | gi:22854596 |
| 4012: | AY775132 | gi:55376008 | 4072: | AY318766 | gi:37961298 | 4132: | AF378799 | gi:22854594 |
| 4013: | AY150312 | gi:25361009 | 4073: | AY457635 | gi:38385769 | 4133: | AF378798 | gi:22854592 |
| 4014: | AY747596 | gi:53850879 | 4074: | AX663104 | gi:29163636 | 4134: | AF378797 | gi:22854590 |
| 4015: | AY747595 | gi:53850877 | 4075: | AX663099 | gi:29163631 | 4135: | AF176348 | gi:22658020 |
| 4016: | AY588319 | | 4076: | AY150564 | gi:27549163 | 4136: | AF494042 | gi:20271246 |
| 4017: | AY737282 | gi:52630407 | 4077: | AF486484 | gi:28453844 | 4137: | AF514803 | gi:21435696 |
| 4018: | AY684971 | gi:51173165 | 4078: | AF486483 | gi:28453842 | 4138: | AY035944 | gi:21303335 |
| 4019: | AF396839 | gi:33307229 | 4079: | AF486482 | gi:28453840 | 4139: | AY035943 | gi:21303331 |
| 4020: | AF396833 | gi:33307181 | 4080: | AF486481 | gi:28453838 | 4140: | AY035942 | gi:21303327 |

| Accession No. | GI No. | Accession No. | GI No. | Accession No. | GI No. |
|---|---|---|---|---|---|
| 4141: AY035941 | gi:21303323 | 4201: AF299414 | gi:13377207 | 4261: AF176465 | gi:7107094 |
| 4142: AY035940 | gi:20975232 | 4202: AF299413 | gi:13377199 | 4262: AF176464 | gi:7107092 |
| 4143: AY035939 | gi:20975230 | 4203: AF299412 | gi:13377191 | 4263: AF176463 | gi:7107090 |
| 4144: AY035938 | gi:20975228 | 4204: AF299411 | gi:13377183 | 4264: AF176462 | gi:7107088 |
| 4145: AY035937 | gi:20975226 | 4205: AF299410 | gi:13377175 | 4265: AF176461 | gi:7107086 |
| 4146: AY035936 | gi:20975224 | 4206: AF299409 | gi:13377167 | 4266: AF176460 | gi:7107084 |
| 4147: AY035935 | gi:20975222 | 4207: AF299408 | gi:13377159 | 4267: AF176459 | gi:7107082 |
| 4148: AY035934 | gi:20975220 | 4208: AF299407 | gi:13377151 | 4268: AF176458 | gi:7107080 |
| 4149: AY035933 | gi:20975218 | 4209: AF299406 | gi:13377143 | 4269: AF176457 | gi:7107078 |
| 4150: AY035932 | gi:20975216 | 4210: AF299405 | gi:13377135 | 4270: AF176456 | gi:7107076 |
| 4151: AY035931 | gi:20975214 | 4211: AF299404 | gi:13377127 | 4271: AF176455 | gi:7107074 |
| 4152: AY035930 | gi:20975212 | 4212: AF325691 | gi:12744849 | 4272: AF176454 | gi:7107072 |
| 4153: AY035929 | gi:20975210 | 4213: AH006184 | gi:3242812 | 4273: AF176453 | gi:7107070 |

FIG. 6 (con't)

| | | | | | | | | |
|---|---|---|---|---|---|---|---|---|
| 4154: | AY035928 | gi:20975208 | 4214: | AF066068 | gi:3242811 | 4274: | AF176452 | gi:7107068 |
| 4155: | AY035927 | gi:20975206 | 4215: | AF331831 | gi:12240324 | 4275: | AF176451 | gi:7107066 |
| 4156: | AY035926 | gi:20975204 | 4216: | U87392 | gi:11192298 | 4276: | AF176450 | gi:7107064 |
| 4157: | AY035925 | gi:20975202 | 4217: | M96262 | gi:11125727 | 4277: | AF176449 | gi:7107062 |
| 4158: | AY035924 | gi:20975200 | 4218: | AF253537 | gi:10179826 | 4278: | AF176448 | gi:7107060 |
| 4159: | AY035923 | gi:20975198 | 4219: | AF253536 | gi:10179824 | 4279: | AF176447 | gi:7107058 |
| 4160: | AY035922 | gi:20975196 | 4220: | AF253535 | gi:10179822 | 4280: | AF176446 | gi:7107056 |
| 4161: | AY035921 | gi:20975194 | 4221: | AF253534 | gi:10179820 | 4281: | AF176445 | gi:7107054 |
| 4162: | AY035920 | gi:20975192 | 4222: | AF253533 | gi:10179818 | 4282: | AF176444 | gi:7107052 |
| 4163: | AY035919 | gi:20975190 | 4223: | AF253532 | gi:10179816 | 4283: | AF176443 | gi:7107050 |
| 4164: | AY035918 | gi:20975188 | 4224: | AF253531 | gi:10179814 | 4284: | AF176442 | gi:7107048 |
| 4165: | AY035917 | gi:20975186 | 4225: | AF095519 | gi:5001666 | 4285: | AF176441 | gi:7107046 |
| 4166: | AY035916 | gi:20975184 | 4226: | AF095518 | gi:5001665 | 4286: | AF176440 | gi:7107044 |
| 4167: | AY035915 | gi:20975182 | 4227: | AF095517 | gi:5001664 | 4287: | AF176439 | gi:7107042 |
| 4168: | AY035914 | gi:20975180 | 4228: | AF095516 | gi:5001663 | 4288: | AF176438 | gi:7107040 |
| 4169: | AY035913 | gi:20975178 | 4229: | AF095515 | gi:5001662 | 4289: | AF176437 | gi:7107038 |
| 4170: | AY035912 | gi:20975176 | 4230: | AF095514 | gi:5001661 | 4290: | AF176436 | gi:7107036 |
| 4171: | AY035911 | gi:20975174 | 4231: | AF095513 | gi:5001660 | 4291: | AF176435 | gi:7107034 |
| 4172: | AY035910 | gi:20975172 | 4232: | AF095512 | gi:5001659 | 4292: | AF176434 | gi:7107032 |
| 4173: | AY035909 | gi:20975170 | 4233: | AF095511 | gi:5001658 | 4293: | AF176433 | gi:7107030 |
| 4174: | AY035908 | gi:20975168 | 4234: | AF095510 | gi:5001657 | 4294: | AF176432 | gi:7107028 |
| 4175: | AY035907 | gi:20975166 | 4235: | AF095509 | gi:5001656 | 4295: | AF176431 | gi:7107026 |
| 4176: | AY035906 | gi:20975164 | 4236: | AF095508 | gi:5001655 | 4296: | AF176430 | gi:7107024 |
| 4177: | AY035905 | gi:20975162 | 4237: | AF095507 | gi:5001654 | 4297: | AF176429 | gi:7107022 |
| 4178: | AY035904 | gi:20975160 | 4238: | AF095506 | gi:5001653 | 4298: | AF176428 | gi:7107020 |
| 4179: | AY035903 | gi:20975158 | 4239: | AF095505 | gi:5001652 | 4299: | AF176427 | gi:7107018 |
| 4180: | AY035902 | gi:20975156 | 4240: | AF095504 | gi:5001651 | 4300: | AF176426 | gi:7107016 |
| 4181: | AY035901 | gi:20975154 | 4241: | AF095503 | gi:5001650 | 4301: | AF176425 | gi:7107014 |
| 4182: | AY035900 | gi:20975152 | 4242: | AF095502 | gi:5001649 | 4302: | AF176424 | gi:7107012 |
| 4183: | AF339500 | gi:13430358 | 4243: | AF095501 | gi:5001648 | 4303: | AF188680 | gi:6118408 |
| 4184: | AF339499 | gi:13430356 | 4244: | AF095500 | gi:5001647 | 4304: | AF121131 | gi:4886916 |
| 4185: | AF339498 | gi:13430354 | 4245: | AF095499 | gi:5001646 | 4305: | AF121267 | gi:4689233 |
| 4186: | AF339497 | gi:13430352 | 4246: | AF184212 | gi:7650192 | 4306: | AF066384 | gi:4680470 |
| 4187: | AF339496 | gi:13430350 | 4247: | AF159149 | gi:9931316 | 4307: | AB023782 | gi:4512577 |
| 4188: | AF339495 | gi:13430348 | 4248: | AF176478 | gi:7107120 | 4308: | AF046869 | gi:3776244 |
| 4189: | AF339494 | gi:13430346 | 4249: | AF176477 | gi:7107118 | 4309: | AF035409 | gi:2739189 |
| 4190: | AF339493 | gi:13430344 | 4250: | AF176476 | gi:7107116 | 4310: | AF030306 | gi:2739142 |

FIG. 6 (con't)

| | | | | | |
|---|---|---|---|---|---|
| 4191: AY032626 | gi:14250956 | 4251: AF176475 | gi:7107114 | 4311: AF090173 | gi:3746910 |
| 4192: X92942 | gi:1061205 | 4252: AF176474 | gi:7107112 | 4312: U40701 | gi:1518915 |
| 4193: AJ223078 | gi:2695776 | 4253: AF176473 | gi:7107110 | 4313: U40700 | gi:1518913 |
| 4194: AJ223082 | gi:2695804 | 4254: AF176472 | gi:7107108 | 4314: U40699 | gi:1518911 |
| 4195: AJ223081 | gi:2695797 | 4255: AF176471 | gi:7107106 | 4315: U40698 | gi:1518909 |
| 4196: AJ223080 | gi:2695790 | 4256: AF176470 | gi:7107104 | 4316: U40697 | gi:1518907 |
| 4197: AJ223079 | gi:2695783 | 4257: AF176469 | gi:7107102 | 4317: U40696 | gi:1518905 |
| 4198: AF299417 | gi:13377231 | 4258: AF176468 | gi:7107100 | 4318: U40695 | gi:1518903 |
| 4199: AF299416 | gi:13377223 | 4259: AF176467 | gi:7107098 | 4319: U40694 | gi:1518901 |
| 4200: AF299415 | gi:13377215 | 4260: AF176466 | gi:7107096 | 4320: U40692 | gi:1518899 |

| Accession No. | GI No. |
|---|---|
| 4321: U40691 | gi:1518897 |
| 4322: U40690 | gi:1518895 |
| 4323: U40689 | gi:1518893 |
| 4324: U40688 | gi:1518891 |
| 4325: U40687 | gi:1518889 |
| 4326: AF013106 | gi:3378049 |
| 4327: Z82995 | gi:1684721 |
| 4328: A26843 | gi:1249605 |
| 4329: L40898 | gi:725327 |
| 4330: U40702 | gi:1304565 |
| 4331: L04493 | gi:294331 |

PRRSV GP5 BASED COMPOSITIONS AND METHODS

RELATED APPLICATIONS

This application claims benefit of priority from U.S. Provisional Patent Application 60/915,049, filed Apr. 30, 2007, which is hereby incorporated in its entirety as if fully set forth.

FIELD OF THE DISCLOSURE

This disclosure includes compositions and methods directed to the use of porcine reproductive and respiratory syndrome (PRRS) virus, or PRRSV, polypeptides in the generation of an immune response against the polypeptide, and therefore PRRSV. The disclosure is based in part on the recognition that use of more than one GP5 ectodomain, differing in sequence within an HV-2 hypervariable region, allows generation of a broader immune response against PRRSV than with the use of a single ectodomain. Also disclosed is the use of nucleic acid molecules encoding more than one ectodomain to produce a broader immune response. The description includes compositions containing polypeptides with more than one of the ectodomains, or one or more nucleic acid molecule encoding the polypeptides. Also described are methods to produce an immune response by using polypeptides, nucleic acid molecules encoding them, and/or a composition of the disclosure.

BACKGROUND OF THE DISCLOSURE

PRRSV belongs to the family Ateriviridae, one of animal RNA virus families. Antigenic properties of PRRS viruses, like other RNA viruses, continually change, which results in a most problematic issue in developing an effective vaccine against this disease causing agent. However, there are fundamentals that are not changed in the PRRSV biological system. Importantly, the virus infects a host cell of a multicellular organism for its replication or growth. To infect, the virus must attach to a host cell as part of its life cycle. For attachment, the virus must have a viral receptor recognition protein (RRP) that recognizes one or more specific receptors on the host cell. Last, the host cell's receptor generally does not change because it is usually required for a particular function and so not intended for virus recognition.

But a virus utilizes the cell's receptor to attach or recognize the host cell. Rather than modifying the receptor structure, an organism containing the host cell may produce antibodies that recognize the RRP of the virus to block attachment of virus to the host cell. The antibodies are commonly referred to as neutralizing antibodies (NA). In response, a population of virus often contains or produces modifications to its RRP that allow escape from NA recognition. However, the modifications to the RRP are limited by the fact that the modified RRP must still recognize the cellular receptor for virus attachment. If a modification results in a non-functional RRP, the virus cannot attach, and so cannot replicate or survive.

BRIEF SUMMARY OF THE DISCLOSURE

The disclosure relates to a three-dimensional arrangement of amino acid residues present in the GP5 protein of porcine reproductive and respiratory syndrome (PRRS) virus, or PRRSV. The arrangement of residues, or polypeptide domain, is present at the N-terminal portion of the GP5 protein, and has been referred to as the ectodomain of the GP5 protein. The disclosure includes use of the domain in the context of a peptide, a polypeptide, a viral particle, or other protein containing composition. In some embodiments, the domain may be present in the form of a recombinant or fusion, peptide or polypeptide. In other embodiments, the domain may be present in, or with, a recombinant viral particle or virus. In further embodiments, a nucleic acid molecule encoding a peptide or polypeptide containing the domain may be used to express the domain for the practice of the disclosure.

The disclosure is based in part on the unexpected discovery that ectodomains that vary in sequence within a previously unappreciated, HV-2 hypervariable region, may be selected for use in the preparation and use of materials to generate an immune response, including a protective response, in an animal against PRRSV. In some cases, at least two PRRSV isolates, each containing a different GP5 protein due to at least one sequence difference within the HV-2 region, are prepared and used to generate an immune response. In other cases, at least three or four PRRSV isolates, each containing a different GP5 protein due to sequence differences at least within the HV-2 region, are prepared and used to produce a protective response.

The disclosure includes the recognition that following a putative signal sequence, the GP5 ectodomain may be viewed as a combination of three regions that precede a putative transmembrane region (or membrane spanning domain or MSD). In sequential order from the N-terminus to the C-terminus of the GP5 protein, the regions are the HV-1 hypervariable region ("HV1"), the conserved region ("CR"), and the HV-2 hypervariable region ("HV2"), which is then followed by a putative transmembrane region ("TR" or MSD). FIG. 1 provides a non-limiting example. Because of the identification of the HV2 as important to the generation of an immune response against PRRSV, the disclosure includes combinations of at least two GP5 ectodomains where they differ in the sequence of the HV2. In some cases, the at least two ectodomains may be present in at least two PRRSV isolates, which may be administered to produce an immune response as described herein.

So in a first aspect, the disclosure includes a combination of at least a first polypeptide domain and a second polypeptide domain, where each domain contains a conserved GP5 motif covalently linked to an HV2 and each domain is antigenic in an animal subject to PRRSV infection. In many embodiments, the linkage is a peptide bond, or amide linkage between amino acid residues in a polypeptide. The GP5 motif and HV2 may be contiguous such that the HV2 follows immediately after the motif in the same polypeptide molecule. In other embodiments, the motif and HV2 may be separated by a linker, such as one or more amino acid residues. In further embodiments, the motif and HV2 may be joined via a chemical linkage other than a peptide bond.

This aspect of the disclosure includes alternative embodiments of the first and second polypeptide domains wherein at least one of the domains is an expanded domain that further contains an HV1 covalently linked to the conserved GP5 motif. This results in at least one domain containing at least three regions: the HV1, the conserved region (CR) containing the conserved GP5 motif, and the HV2, in sequential order. Of course embodiments of the disclosure include combinations of two, or more than two domains, such as three or four domains, where at least two of the domains are expanded domains as described herein. In some cases, each of the domains in a combination is an expanded domain.

In some embodiments, a combination of at least two polypeptide domains is a combination of at least two PRRSV isolates, each of which contains at least one of the domains. In many cases, each of the domains is an expanded domain containing the HV1, the CR, and the HV2, where each domain is different because of at least one sequence difference within the HV2. Of course the domains may optionally contain other sequence differences, such as one or more differences in the HV1.

A combination of domains may be present in a combination of GP5 polypeptides, each of which is present on a PRRSV isolate. Thus the disclosure includes a combination of two or more isolates, each containing a GP5 protein with an expanded polypeptide domain containing a different HV2 sequence as described herein. For example, and in a non-limiting combination of four isolates, a first polypeptide domain is present in a first isolate, a second polypeptide domain is present in a second isolate, a third polypeptide domain is in a third isolate, and a fourth polypeptide domain is present in a fourth isolate. Each of the isolates would differ from the others at least due to a different HV2 sequence in a GP5 protein of the isolate. Of course other sequence differences, such as one or more differences in the HV1, may also be present in the isolates.

In polypeptide based embodiments beyond GP5 protein, the first and second polypeptide domains may be located on the same molecule or on two separate polypeptide molecules. The first and second domains each contain a conserved GP5 motif, represented by the amino acid sequence C(E/S)LNG (T/A), SEQ ID NO: 1. Embodiments of the disclosure include combinations wherein the conserved GP5 motif in each of the two domains is identical. Alternatively, the first and second domains may differ in sequence, and so structure, via the limited variability (four possible sequences) within the conserved motif as indicated by SEQ ID NO: 1.

As described herein, each of the domains in a combination includes an HV2, the sequence of which differs among each of the domains. In cases of an expanded domain, the HV1 sequence may optionally also differ between each of the domains. This is based in part upon the non-limiting view that an expanded domain containing the HV 1, the CR, and the HV2 forms a recognition "pocket" which should differ among the different domains of a combination to provide increased diversity when the combination is used to produce an immune response. So by way of a non-limiting example, a sequence difference in the HV2 may result in an alteration in "pocket" structure while sequence changes in both the HV2 and the HV1 may result in a different alteration to the "pocket" structure. And while some embodiments of the disclosure include sequence changes only in the HV2 and the HV1, other embodiments may include sequence changes in the CR.

In many embodiments, the HV2 contains about 8 amino acid residues and/or a conserved portion represented by the tripeptide sequence $X_0$WL, where $X_0$ is one of the 20 naturally occurring amino acid residues. This tripeptide sequence may be located at the beginning, or N-terminal end, of the HV2. In some embodiments, the conserved tripeptide sequence comprises the sequence DWL, wherein $X_0$ is aspartic acid (D). In other embodiments, $X_0$ is asparagine (N) or any other amino acid residue except aspartic acid (D). In further embodiments $X_0$ is an acidic amino acid residue, such as glutamic acid (E) or glutamine (Q); a basic amino acid residue, such as arginine (R), lysine (K), or histidine (H); an amino acid residue with an aliphatic sidechain, such as alanine (A) or isoleucine (I) or glycine (G) or leucine (L) or valine (V); an amino acid residue with a hydroxyl containing sidechain, such as threonine (T) or serine (S); or an amino acid residue with an aromatic sidechain, such as tyrosine (Y).

In a second aspect, the disclosure is based upon the antigenicity and/or immunogenicity of the conserved GP5 motif and HV2 in each of the domains in a combination of two or more domains. In some embodiments, the presence of a conserved GP5 motif and an HV2, and optionally an HV1 to form a recognition "pocket", in each of at least two domains produces antigenic and/or immunogenic, and so the disclosure includes antigenic and immunogenic compositions containing the domains. In additional embodiments, each of the domains is present in a separate polypeptide molecule that is bound or associated with a cell membrane or other lipid bilayer. In some cases, the polypeptide molecule contains a TR, such as a GP5 transmembrane domain, which facilitates association with a membrane or lipid bilayer. In some embodiments, the membrane may be a cell-free membrane or a fragment or portion of a cellular membrane, such as an envelope or coat surrounding a viral particle produced by a cell.

Further compositions include two or more polypeptide molecules that are membrane bound, or membrane associated, such as to a single viral particle or to separate viral particles. The viral particle(s) may be infectious or non-infectious, and independently, it may be replication competent or incompetent. A viral particle may be a PRRSV particle or that of another virus such as a recombinant viral particle that contains the polypeptide molecules. Non-limiting examples of recombinant viral particles that may be used to express a polypeptide of the disclosure include porcine adenovirus and poxvirus.

A viral particle that is both infectious and replication competent may be referred to as a virion. So in some embodiments, the composition may contain two or more polypeptide molecules that are membrane bound, or membrane associated, such as to a single virion or to separate virions. In embodiments of compositions containing two or more virions, such as two or more PRRSV particles, one or more may be a naturally occurring PRRSV particle or isolate that contains a first or second polypeptide domain as described herein. In some cases, more than one, up to all, of the particles are naturally occurring isolates.

Of course additional embodiments of the disclosure include combinations of more than two polypeptide domains or viral particles, each of which contains a conserved GP5 motif and an HV2, optionally with an HV1, as described herein. So compositions comprising additional polypeptide domains beyond a first and second polypeptide domain are expressly within the scope of the disclosure. Of course in such embodiments, the HV2, and optionally the HV1, in each polypeptide domain of a combination differs in sequence, and so structure, from the HV2, and optionally the HV1, in each of the other domains in the combination.

In a further aspect, the disclosure includes a method of preparing a composition described herein. In some embodiments, a method may comprise identifying or selecting at least a first polypeptide domain and a second polypeptide domain, each domain as described herein, and combining the domains to form a composition. In many cases, a method may comprise identifying or selecting at least a first polypeptide molecule containing the first domain and a second polypeptide molecule containing the second domain, and combining the polypeptides to form a composition. In some cases, the combining may comprise addition of one or more pharmaceutically acceptable excipients and/or carriers in forming a composition.

In other embodiments, the identifying or selecting may be among PRRSV isolates based upon the sequence of the HV2 in each isolate. In some cases, the identification or selection may be by detection of the HV2 sequence along with one or more other portions of the GP5 molecule, such as the conserved motif or the HV1. One non-limiting example of a detection method includes use of an antibody that recognizes a given HV2 sequence, optionally in combination with, or in the context of, another portion of the GP5 molecule. Other non-limiting detection methods include amino acid sequencing of the HV2 or nucleic acid sequencing of the sequence encoding the HV2.

In some embodiments, the detection may be of PRRSV in a sample of a biological fluid from an animal subject, such as an individual infected with PRRSV. The method may comprise contacting the sample, or a diluted form thereof, with a binding agent which binds at least a portion of the HV2 in a GP5 protein. The sample may be from a porcine subject, but any subject infected by PRRSV, or a PRRSV carrier, may be used. The biological fluid may be any fluid in which GP5 protein and/or PRRSV particles may be detectably present. Non-limiting examples include the bodily secretions of a subject, such as saliva, tears, mucous, nasal discharge, and vaginal secretions as well as other bodily fluids such as blood, serum, plasma, semen, seminal fluid, and urine as well as any fluid component of feces or a fluid extract of feces.

In further embodiments, the identification, selection, or detection may be of, or for, a novel PRRSV isolate that does not have an HV2 with a sequence as disclosed herein. A novel isolate may be advantageously used in a combination of the disclosure, such as with one, two, three, four, or more domain containing PRRSV isolates disclosed herein. A combination with a novel isolate would be expected to be advantageous because it would have a higher likelihood of producing an antibody or immune response which is novel when compared to the response to a combination lacking the novel isolate.

As indicated above, an additional aspect of the disclosure is a method of producing an antibody response (humoral immune response) or an immune response. In some embodiments, a method may comprise administering a combination of polypeptide domains, as described herein, to an animal subject with an immune system capable of producing the response. While a given response may be viewed as including a response directed to the domains or to polypeptides containing the domains, the disclosure includes generation of a response that also recognizes GP5 in one or more PRRSV isolates. In some embodiments, the antibody response includes the production of one or more neutralizing antibodies. In other embodiments, the immune response includes the production of one or more cellular immune responses, such as a T cell mediated response. In some cases, the antibody response or immune response is a protective response against a PRRSV particle, such as one expressing a GP5 protein containing a polypeptide domain of the disclosure.

In some cases, the antibody response or immune response is against at least two varieties, or strains, of PRRSV that differ in the HV2, such as those likely to be present within a particular geographic region. So embodiments of the disclosure include a response against one or more varieties of a Lelystad isolate prevalent in Europe, one or more varieties of a North American or Korean serotype of PRRSV, or one or more varieties of PRRSV found in Asia or South America.

In additional embodiments, a method of producing an antibody or immune response in a subject may comprise identifying or selecting, as described herein, at least a first polypeptide domain and a second polypeptide domain, followed by administering the selected domains to a subject to produce the antibody or immune response. In some embodiments, the identifying or selecting may be of at least a first polypeptide comprising the first polypeptide domain and a second polypeptide comprising the second polypeptide domain, followed by administering the selected polypeptides to the subject. In many cases, at least one of the first and second polypeptides may be present in a PRRSV isolate. In some cases, each of the polypeptides is present in a PRRSV isolate.

In alternative embodiments, the identifying or selecting may be of at least a first PRRSV isolate comprising the first polypeptide domain and a second PRRSV isolate comprising the second polypeptide domain, followed by administering the selected isolates to the subject. In some embodiments, the identifying or selecting is of at least three or at least four, or more, isolates. In many cases, the selecting is based upon the HV2 sequence in a GP5 protein of the PRRSV isolate. The identification or selection based upon the HV2 sequence may be performed by any suitable method, including, but not limited to, amino acid sequence analysis of the HV2, PCR-based or antibody-based detection of the HV2; or knowledge of the HV2 sequence in a previously characterized PRRSV isolate.

The details of one or more embodiments of the disclosure are set forth in the accompanying drawings and the description below. Other features, objects, and advantages of the disclosure will be apparent from the drawings and detailed description, and from the claims.

BRIEF DESCRIPTION OF THE DRAWINGS

FIG. 1 shows a comparison of the amino acid sequences of a representative American type PRRSV strain (VR-2332) and a European type PRRSV strain (Lelystad strain, LV). The putative signal sequences of each are identified along with the HV 1, "Conserved Region" or CR (containing the conserved GP5 motif), and the HV2 (underlined). A representative, and non-limiting starting position for the HV1 is also indicated.

FIG. 3 shows an alignment of a portion of the GP5 ectodomain sequence, including the conserved GP5 motif and the HV2, from publicly accessible PRRSV sequences. The NCBI (National Center for Biotechnology Information) accession numbers corresponding to the sequences are indicated along with isolates. The isolates include both North American and European strains as well as other types.

FIG. 6 provides the GenBank accession and GI numbers for representative PRRSV GP5 protein coding sequences.

DEFINITIONS

Figure 2:
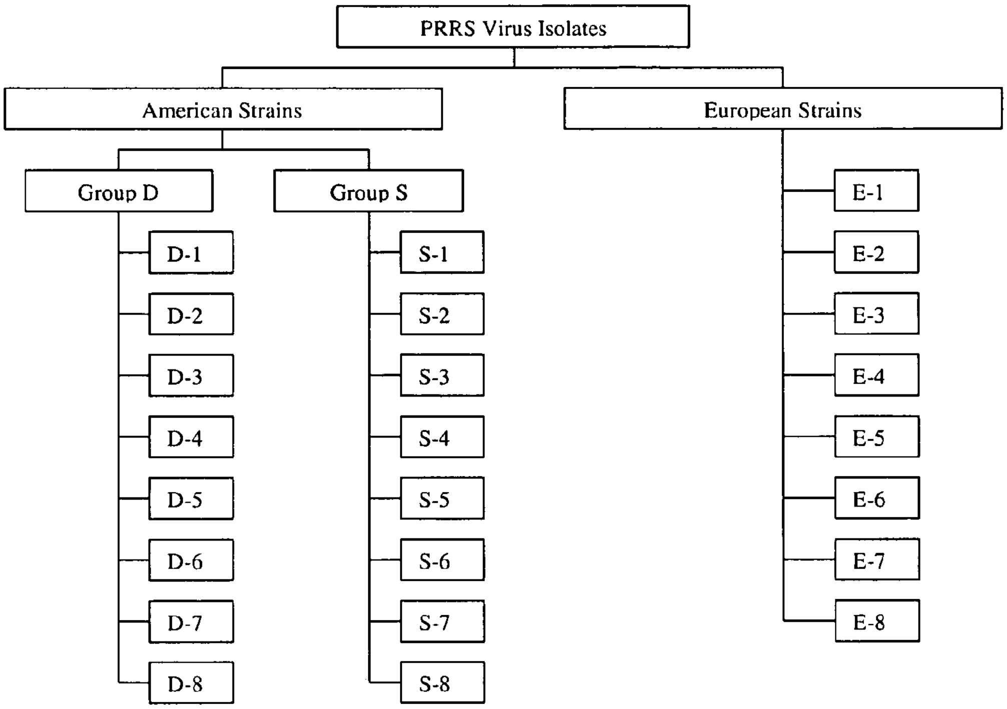
FIG. 2 is a schematic representation of groups of PRRSV isolates as disclosed herein.
Figure 4:
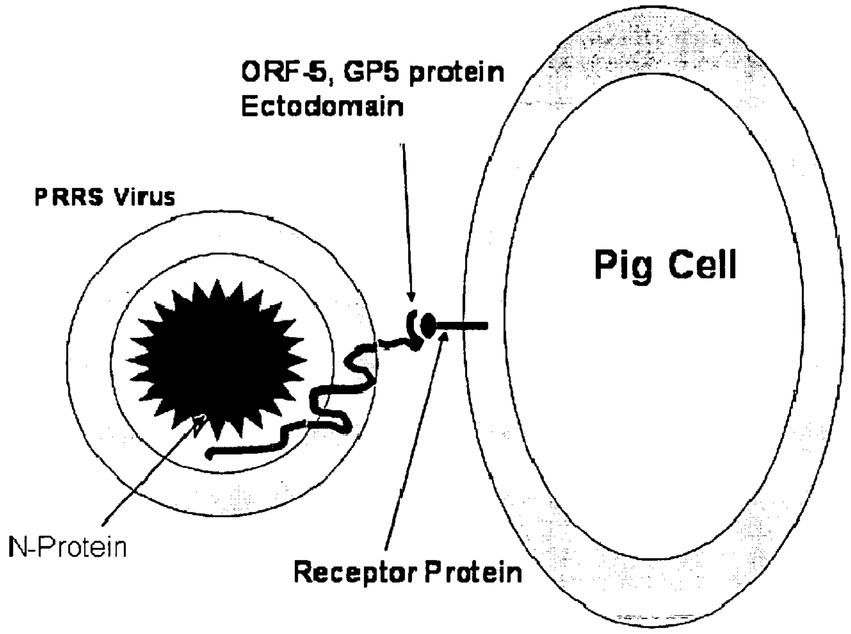
FIG. 4 illustrates GP5 protein mediated interactions between PRRSV and a host pig cell.
Figure 5:
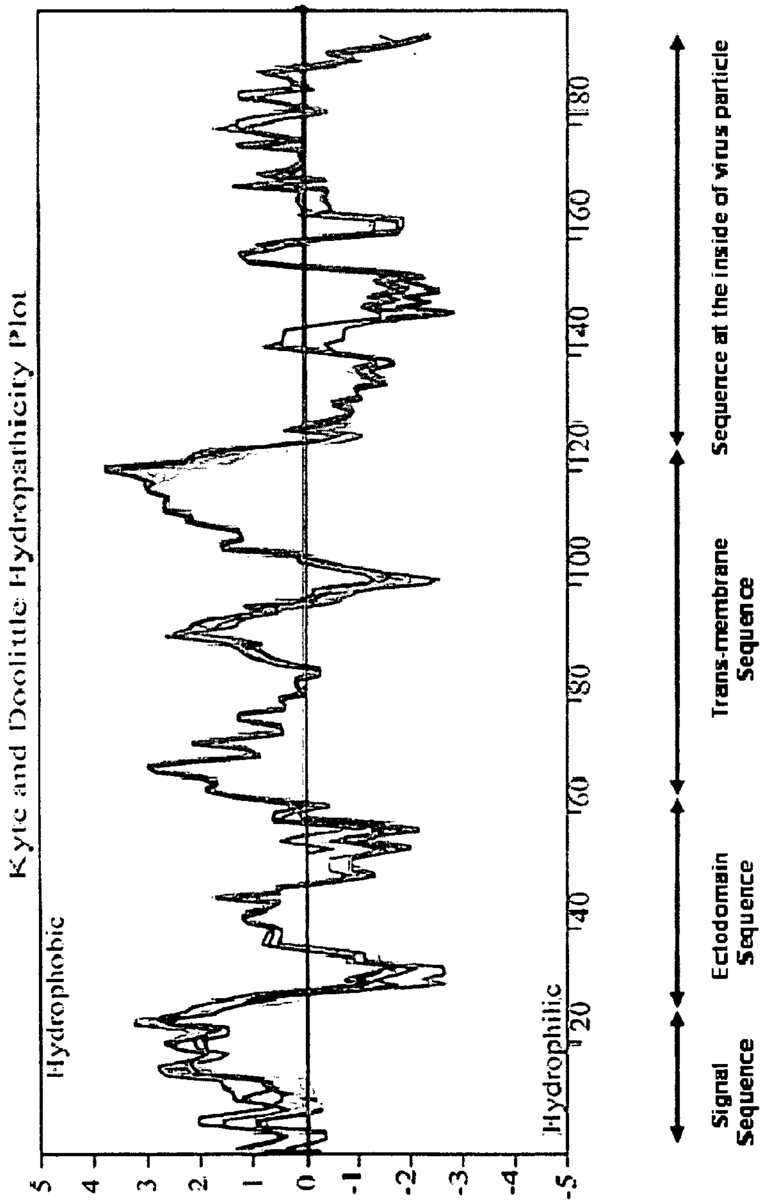
FIG. 5 is a Kyte-Doolittle hydrophobicity plot of the amino acid sequence of GP5 protein. The indicated numbering is from an American isolate. There is a rapid shift to hydrophobic residues at about amino acid residue 62, corresponding to the start of a putative transmembrane region.

As used herein, the terms porcine reproductive and respiratory syndrome (PRRS) virus, or PRRSV, refer to a virus which has been reported to cause PRRS; Mystery Swine Disease (MSD); Swine Infertility and Respiratory Syndrome (SIRS), which was previously known as "blue-eared syndrome"; porcine epidemic abortion and respiratory syndrome (PEARS); Wabash syndrome; mystery pig disease (MPD); swine plague; blue abortion disease or blue ear disease in the United Kingdom; abortus blau in the Netherlands; seuchenhafter spatabort der schweine in Germany; and Heko-Heko disease (Shimizu et al., 1994). Additional alternative names of the virally caused condition include Blue ear disease, Blue-eared pig disease, Enfermedad misteriosa del cerdo, Epidemisch spätabort der sauen, Lane r bing (Chinese), Maladie blue du porc, Maladie mystérieuse du porc, Mystery pig disease, New pig disease, Plague of 1988-1989, Rätselhafte schweinekrankheit, Síndrome disgenésico y respiratorio del cerdo, Síndrome misterioso del cerdo, Syndrom reproductive et respiratoire du porc, Syndrome dysgénésique et respiratoire du porc, and Syndrome HAAT (Hyperthermie-Anorexie-Avortement de la Truie).

The terms "GP5 protein" and "major envelope glycoprotein" of PRRSV as used herein refer to the polypeptide encoded by ORF5 of a PRRSV genome as understood in the art. Representative, and non-limiting, GP5 sequences coding sequences include those identified by the accession and GI numbers provided in FIG. 6. Without being bound by theory, and offered to improve the understanding of the disclosure, GP5 protein encoded by ORF5 of the PRRSV genome is believed to be a receptor recognition protein (RRP) in PRRSV. The ectodomain of GP5 protein starts from about amino acid N30 to about D61 for the American strain and from about D33 to G63 for European strains (see FIG. 1). The typical differences between American-type strains and European strains are (1) the total amino acids for GP5 proteins are 200 and 201, respectively, (2) European strains have a longer signal sequence compared to American strains, and (3) European strains show less variations compared to American strains. The disclosure is based in part upon the analysis, and identification of the HV2 in each, of approximately 1740 GP5 sequences and their respective ectodomains. Representative sequences are shown in FIG. 3. While the disclosure may be practiced with the use of those representative sequences, the disclosure is not limited to them.

The term "HV-1 region" or "HV 1" refers to a polypeptide sequence present at the N-terminal end of the conserved region of GP5 as described herein. The region is optionally present in a polypeptide domain of the disclosure. But when present, the sequence may be up to about 14 or more amino acid residues in length, with lengths of 11, 12, 13 and 14 being specifically contemplated. In other embodiments, lengths of about 11, about 9, about 7, about 5, or about 3 or fewer residues may also be used. The disclosure includes embodiments wherein this region varies considerably in sequence. Non-limiting examples of HV1 sequences include those present in FIG. 3.

Amino acid residues in the disclosed sequences may be conservatively substituted, or replaced, by another residue with similar characteristics and properties. As used herein, conservative amino acid substitutions of the disclosure are shown in Table 1 below.

TABLE 1

| Definition | Amino Acid | Symbol |
|---|---|---|
| Amino Acids with Aliphatic R-Groups | Glycine | Gly—G |
| | Alanine | Ala—A |
| | Valine | Val—V |
| | Leucine | Leu—L |
| | Isoleucine | Ile—I |
| Amino Acids with Hydroxyl R-Groups | Serine | Ser—S |
| | Threonine | Thr—T |
| Amino Acids with Sulfur-Containing R-Groups | Cysteine | Cys—C |
| | Methionine | Met—M |
| Acidic Amino Acids | Aspartic Acid | Asp—D |
| | Asparagine | Asn—N |
| | Glutamic Acid | Glu—E |
| | Glutamine | Gln—Q |

TABLE 1-continued

| Definition | Amino Acid | Symbol |
|---|---|---|
| Basic Amino Acids | Arginine | Arg—R |
| | Lysine | Lys—K |
| | Histidine | His—H |
| Amino Acids with Aromatic Rings | Phenylalanine | Phe—F |
| | Tyrosine | Tyr—Y |
| | Tryptophan | Trp—W |
| Imino Acids | Proline | Pro—P |

DETAILED DESCRIPTION OF MODES OF PRACTICING THE DISCLOSURE

General

The disclosure is based in part on an analysis of current PRRSV genetic information, such as the DNA sequences of the GP5 protein. Sequences of PRRSV isolated from pigs showing clinical PRRS symptoms were also analyzed. The analysis led to the identification of two hyper variable regions, HV-1 and HV-2, where the HV-2 region begins with either an $X_0$WL tripeptide motif wherein $X_0$ is one of the 20 naturally occurring amino acid residues as described herein. The analysis also led to the identification of a conserved region in positions 142 to T53 in an American strain, and positions 144 to T55 in a European strain (see FIG. 1).

Existence of a conserved region in the ectodomains among American strains and European strains of PRRSV indicates that the conserved region participates in direct contact between GP5 protein, as a receptor recognition protein, and a receptor on a host cell to be infected by PRRSV. Based on this idea, and without being bound by theory, the two HV regions on either side of the conserved region are believed to serve as "gates" (or structural motifs) that maintain the hydrophobic properties of the conserved region. Previous commentaries on the HV-1 region and the conserved region did not advance the studies of GP5 protein immunogenicity because there were too many variations in the HV-1 area. But in light of the hypervariability in HV-2, it was illogical to expect that HV-2 would participate in interactions between GP5 and a host cell receptor.

The instant disclosure is also based in part on the recognition that variations in the HV-1 region may be considered in combination with HV-2 sequences that display less variation. Therefore, the instant disclosure includes (1) sorting PRRSV isolates based upon HV2 sequence variations to group them based upon immunological similarities; and (2) selecting combinations of PRRSV strains in different groups to make broad spectrum vaccines that provide broader, heterologous protection upon administration. The sorting and selection may optionally include consideration of the HV-1 region. Additionally, the isolates are optionally first attenuated or inactivated prior to their administration as a vaccine or immunogenic composition. Non-limiting examples of attenuation include methods known to the skilled person, such as serial passage in culture, such as in cells or tissue, or passage in animals. Of course the passaging may be conducted in vitro. Non-limiting examples of inactivation include those known to the skilled person, such as heating, irradiation, chemical inactivation treatments.

The disclosure includes the optional division of all American strains into two groups based on amino acid position 61. More than 85% of American-type isolates have been reported to include D (Asp) or S (Ser) at position 61. The exceptions (less than 15%) usually have amino acid residues at position 61 other than C (Cys), F (Phe), M (Met), W (Trp), and P (Pro).

Therefore, the disclosure includes embodiments wherein the first HV2 residue, corresponding to position 61, is an amino acid residue other than C, F, M, W, and P. In some embodiments, that residue is selected from A (Ala), G (Gly), V (Val), L (Leu), I (Ile), S (Ser), T (Thr), N (Asn), E (Glu), Q (Gln), R (Arg), K (Lys), H (His), or Y (Tyr). In alternative embodiments, however, that residue is selected from C, F, M, W, or P.

The disclosure includes the optional classification into two groups for American strains; Group D and Group S, with eight sub-groups each (D-1 through D-8 and S-1 through S-8, respectively) based on observed sequence information. The disclosure further includes division of all European strains into eight (8) subgroups (E-1 through E-8) based on observed sequence information. These groupings are illustrated in FIG. 2.

The groups and subgroups are the basis for some embodiments of the disclosure, where a combination of at least a first and second polypeptide domain (each containing a conserved GP5 motif covalently linked to an HV2 as described herein) from different groups or subgroups, may be selected and used to produce a composition or vaccine that produces a broader antibody or immune response than with use of the polypeptide domains separately (or individually). In some embodiments, a combination of two to four, or more, polypeptide domains is used in the practice of the disclosure. In further embodiments, the use of a domain from one group or subgroup may result in the production of an antibody or immune response against more than one domain from the same group or subgroup.

Non-limiting examples of the disclosure include combinations of at least four domains, wherein each of the four is selected, without duplication, from one of the 24 subgroups described herein as D-1 through D-8, S-1 through S-8, and E-1 through E-8. A rough approximation of the number of possible combinations is provided by the mathematical formula $(24\times23\times22\times21)/(4\times3\times2\times1)$, or about 10,600. But in some embodiments, the number of possible combinations are reduced significantly where each combination contains at least one domain from each of the Group D and Group S subgroups as well as one from E-1 through E-8. A rough approximation of such an example is provided by the formula $(8\times8\times8\times21)/(4\times3\times2\times1)$, or about 448. In other embodiments where only Group D and Group S subgroups are used, the number of possible combinations is also reduced. Similarly, embodiments where four domains from E-1 through E-8 are used, the number of possible combinations are further reduced.

More generally, a composition or vaccine of the disclosure may include at least one polypeptide domain from each of the D and S groups as described herein. So a combination of two domains may have one from each of the D and S groups. In other embodiments, a composition or vaccine may include any combination of a D subgroup domain and/or any combination of an S subgroup domain. So a combination of two domains may have both from Group D or both from Group S or one from each group. In many embodiments, the polypeptide domains used in a combination is present in the GP5 protein of a PRRSV isolate that is used as a composition or vaccine of the disclosure. Therefore, the disclosure also includes identification and classification of PRRSV isolates into the same groups and subgroups described herein based upon the HV-2 sequence in the GP5 protein. The classified isolates may then be selected as disclosed.

As additional non-limiting examples, a composition or vaccine of the disclosure may contain

- an isolate or domain from the D-1 subgroup and at least one or more (such as two or three or more) isolates or domains from any other D subgroup or any S or E subgroup;
- an isolate or domain from the D-2 subgroup and at least one or more (such as two or three or more) isolates or domains from any other D subgroup or any S or E subgroup;
- an isolate or domain from the D-3 subgroup and at least one or more (such as two or three or more) isolates or domains from any other D subgroup or any S or E subgroup;
- an isolate or domain from the D-4 subgroup and at least one or more (such as two or three or more) isolates or domains from any other D subgroup or any S or E subgroup;
- an isolate or domain from the D-5 subgroup and an at least one or more (such as two or three or more) isolates or domains from any other D subgroup or any S or E subgroup;
- an isolate or domain from the D-6 subgroup and at least one or more (such as two or three or more) isolates or domains from any other D subgroup or any S or E subgroup;
- an isolate or domain from the D-7 subgroup and at least one or more (such as two or three or more) isolates or domains from any other D subgroup or any S or E subgroup; or
- an isolate or domain from the D-8 subgroup and at least one or more (such as two or three or more) isolates or domains from any other D subgroup or any S or E subgroup.

Alternatively, a composition or vaccine of the disclosure may contain

- an isolate or domain from the S-1 subgroup and at least one or more (such as two or three or more) isolates or domains from any other S subgroup or any D or E subgroup;
- an isolate or domain from the S-2 subgroup and at least one or more (such as two or three or more) isolates or domains from any other S subgroup or any D or E subgroup;
- an isolate or domain from the S-3 subgroup and at least one or more (such as two or three or more) isolates or domains from any other S subgroup or any D or E subgroup;
- an isolate or domain from the S-4 subgroup and at least one or more (such as two or three or more) isolates or domains from any other S subgroup or any D or E subgroup;
- an isolate or domain from the S-5 subgroup and at least one or more (such as two or three or more) isolates or domains from any other S subgroup or any D or E subgroup;
- an isolate or domain from the S-6 subgroup and at least one or more (such as two or three or more) isolates or domains from any other S subgroup or any D or E subgroup;
- an isolate or domain from the S-7 subgroup and at least one or more (such as two or three or more) isolates or domains from any other S subgroup or any D or E subgroup; or

- an isolate or domain from the S-8 subgroup and at least one or more (such as two or three or more) isolates or domains from any other S subgroup or any D or E subgroup.

Similarly, embodiments of the disclosure include a composition or vaccine of the disclosure may contain

- an isolate or domain from the E-1 subgroup and at least one or more (such as two or three or more) isolates or domains from any other E, D, or S subgroup;
- an isolate or domain from the E-2 subgroup and at least one or more (such as two or three or more) isolates or domains from any other E, D, or S subgroup;
- an isolate or domain from the E-3 subgroup and at least one or more (such as two or three or more) isolates or domains from any other E, D, or S subgroup;
- an isolate or domain from the E-4 subgroup and at least one or more (such as two or three or more) isolates or domains from any other E, D, or S subgroup;
- an isolate or domain from the E-5 subgroup and at least one or more (such as two or three or more) isolates or domains from any other E, D, or S subgroup;
- an isolate or domain from the E-6 subgroup and at least one or more (such as two or three or more) isolates or domains from any other E, D, or S subgroup;
- an isolate or domain from the E-7 subgroup and at least or more (such as two or three or more) isolates or domains from any other E, D, or S subgroup; or
- an isolate or domain from the E-8 subgroup and at least one or more (such as two or three or more) isolates or domains from any other E, D, or S subgroup.

In some embodiments, however, a combination of the disclosure is not a combination of the GP5 ectodomains of VR2332 and LV as described herein. In other embodiments, a combination of the disclosure is not a combination of only GP5 ectodomains with the following sequences bridging the boundary between HV2 and the putative transmembrane region of GP5:

| | |
|---|---|
| ANKFDWAVET | (SEQ ID NO: 7) |
| ANKFDWAVEP | (SEQ ID NO: 8) |
| AGEFDWAVET | (SEQ ID NO: 9) |
| ADKFDWAVEP | (SEQ ID NO: 10) |
| ADRFDWAVEP or | (SEQ ID NO: 11) |
| SSHFGWAVET. | (SEQ ID NO: 12) |

But specifically contemplated embodiments of the invention include combinations of domains wherein both the $X_0$ residue in $X_0$WL and at least one additional residue in the HV2 sequence both differ between the domains of a combination.

As described herein, each polypeptide domain (and so each isolate) contains the conserved GP5 motif represented by the amino acid sequence C(E/S)LNG(T/A), SEQ ID NO: 1. So embodiments of the disclosure include domains wherein the GP5 motif is represented by the amino acid sequence CELNGT (SEQ ID NO:2), CELNGA (SEQ ID NO:3), CSLNGT (SEQ ID NO:4), or CSLNGA (SEQ ID NO:5). In other embodiments, the conserved GP5 motif is larger and is represented by the amino acid sequence I(Y/F)(N/D/S/K)(L/S/F/M)(T/P/M)(L/I)C(E/S)LNG(T/A), SEQ ID NO:6, which corresponds to the "Conserved Region" shown in FIG. 1.

Virus Based Compositions

The disclosure is based upon the antigenicity and/or immunogenicity of the conserved GP5 motif and HV2 in a polypeptide domain, used in combination, as described herein. Thus the disclosure includes combinations of viral isolates as described above. Non-limiting examples include combinations of the viral isolates listed in FIG. 3 (based on their sequence deposit information) as they may be classified into the groups and subgroups disclosed herein. In some embodiments, combinations of at least two or more, such as three or four or more, of those isolates are contemplated for use in the practice of the disclosure.

Additionally, the disclosure includes a combination of a viral isolate and a virus particle where each contains a polypeptide of a combination disclosed herein. In other embodiments, two or more virus particles are used. Non-limiting examples of a polypeptide domain containing virus particle of the disclosure include an infectious or non-infectious virus particle, which is independently replication competent or incompetent. Additional non-limiting examples include a virus particle cultured or passaged in vitro; an attenuated virus; and a recombinant viral particle.

In many embodiments, a viral particle is a PRRSV particle with an outer membrane that contains a GP5 protein with a polypeptide domain of the disclosure. In other embodiments, the viral particle may be non-PRRS virus with an outer membrane containing a polypeptide domain, optionally as part of a GP5 protein, as described herein. Further embodiments include a PRRSV or non-PRRSV viral particle with an outer membrane containing two or more of the disclosed polypeptide domains, such as via two or more GP5 proteins with different ectodomains as described herein. In some cases, a viral particle is a PRRSV with a genome that contains multiple copies of GP5 protein encoding ORF5 sequences. Such virus isolates have been previously reported and referred to as an "overproduction mutant" or "high-replication phenotype" PRRSV. The instant disclosure includes such a PRRSV that has been recombinantly modified to contain and express more than one GP5 protein, each containing a polypeptide domain with a different HV2 region as described herein. In other embodiments, a recombinant virus may be an insect virus, such as Baculovirus, which has been previously reported as capable of expressing PRRSV GP5 protein, a porcine adenovirus, or a poxvirus.

In further embodiments, a virus isolate or viral particle is one that is infectious and replication competent, such as a PRRSV isolate or infectious particle. In most cases, the particle contains a genome encoding and capable of expressing GP5 protein after infection in vivo to produce GP5. A particle that is both infectious and replication competent may be referred to as a virion. In alternative embodiments, a particle of the disclosure is infectious and replication incompetent, but optionally capable of intracellularly expressing GP5 proteins.

In embodiments comprising the use of a PRRSV isolate, the isolate may be identified or selected based upon the sequence of the HV2 in an isolate. In some cases, such as that of an isolate represented in FIG. 3 herein, the identification or selection may be based upon review of the sequence information or based upon knowledge of the HV2 sequence in a characterized isolate. In other cases, such as where the isolate has not been previously characterized, the selection may be by detection of the HV2 sequence, such as by use of an antibody that recognizes a given HV2 sequence; sequencing the GP5 coding sequence (ORF5) of the isolate; or purification and amino acid sequencing of the GP5 protein per se. Non-limiting examples of antibody based detection include immunoprecipitation and assays such as ELISA, RIA, and Western blotting. Non-limiting examples of sequencing include dideoxynucleotide-based sequencing of DNA molecules and PCR-based sequencing, including methods based upon reverse transcription of a GP5 encoding RNA molecule followed by PCR. In some embodiments, the selection of an isolate includes detection of the sequence of one or more portions of the GP5 protein beyond the HV2, such as the conserved motif and/or the HV1.

In many embodiments of an antibody based detection method, the antibody does not bind to the GP5 protein as found in multiple PRRSV strains and isolates. Instead, the antibody should be sufficiently specific to the HV2 such that it is capable of detecting a particular isolate based in whole or in part on the HV2 sequence or structure. In addition to the use of an antibody, such as a labeled antibody to facilitate its detection, an antibody fragment that binds the HV2 of a PRRSV GP5 protein may also be used. The antibody fragment may be the Fv or Fab region of an HV2 binding antibody; other non-limiting examples include a single chain antibody, including a single chain Fv region and a single chain Fab region. The antibodies and antibody fragments are preferably monoclonal but may be polyclonal in some cases.

In further embodiments, the detection of a PRRSV isolate is by use of a sample of a biological fluid from a porcine subject, such as an individual infected with PRRSV. The method may comprise contacting the sample, or a diluted form thereof, with a binding agent which binds the HV2 of GP5 protein, preferably to the exclusion of other molecules present in the biological fluid. In many embodiments, the subject is a pig, and the sample may be of a bodily fluid or secretion from a pig. Non-limiting examples of pigs that from which samples may be obtained for use with the present disclosure include boar, sow, fattener, and gilt. The pigs may range in age from 1 to about 30, 31 to about 40, 41 to about 50, or 51 to about 60 days or older.

Of course the biological fluid should be a fluid in which GP5 protein and/or PRRSV particles are detectably present. Non-limiting examples include bodily secretions such as saliva, tears, mucous, nasal discharge, and vaginal secretions as well as other bodily fluids such as blood, serum, plasma, semen, seminal fluid, and urine as well as any fluid component of feces or a fluid extract of feces.

Where the biological fluid contains PRRSV particles, detection may be by use of a PCR-based method to detect a GP5 protein encoding nucleic acid molecule, such as a DNA or RNA molecule containing a GP5 protein or a portion of the molecule encoding at least the HV2.

In additional embodiments, the selection and detection may be of, or for, a PRRSV isolate that has a GP5 protein with an HV2 sequence that differs from any disclosed herein or as previously characterized. Such a novel isolate may still be classifiable into one of the groups or subgroups as disclosed herein. Alternatively, such an isolate may not be classifiable into one of the disclosed groups or subgroups and so may be advantageously used as part of a disclosed combination because the novel isolate would have a higher likelihood of producing a novel antibody or immune response.

The disclosure thus includes a method of producing an antibody or immune response in a subject by use of a PRRSV isolate comprising a GP5 protein with an HV2 sequence that differs from any HV2 sequence disclosed herein. The HV2 of the isolate may thus not be any described herein or encompassed by any of the disclosed groups or subgroups. The method may comprise identifying a PRRSV isolate as comprising a GP5 polypeptide molecule containing an HV2 region distinct from any HV2 sequence of FIG. 3, or any D, S, or E subgroup, and administering said isolate to said subject to produce an antibody or immune response in said subject. The identifying or determining of a distinct HV2 sequence may be by any means disclosed herein, including an antibody or nucleic acid based method as non-limiting examples, followed by comparison to the instant disclosure. In some embodiments, the isolate is attenuated or inactivated as described herein.

Polypeptides and Compositions

The disclosure is based upon the antigenicity and/or immunogenicity of a polypeptide domain containing the conserved GP5 motif and HV2 as described herein. The HV2 portion contributes to the antigenicity and/or immunogenicity of the domain such that the use, in combination, of polypeptide molecules containing two different domains, results in the generation of a broader antibody or immune response in comparison to use of only one of the domains. Accordingly, the disclosure includes combinations of two or more polypeptide domains, such as in a composition or vaccine, as well as their use in a method of immunizing a subject.

The nature of a polypeptide domain has been described herein. Generally, the domain contains a conserved GP5 motif covalently linked to an HV2 region. Many embodiments have a peptide bond, or amide linkage, linking the GP5 motif and the HV2 so that they are contiguous when considering the sequence from N-terminus to the C-terminus. Other embodiments include the use of a linker moiety. Non-limiting examples of a linker moiety include a short peptide sequence, such as about 1, 2, 3, 4, or 5 amino acids in length, and a non-peptide linker, such as a short chain of atoms with at least one carbon atom in the chain or other synthetic linker. In cases of a short peptide sequence, the amino acids may be any naturally occurring amino acid, such as the 20 amino acids of Table 1 herein. In some alternative embodiments, the motif and HV2 may be covalently joined via a non-peptide bond linkage, such as a carbon-carbon bond.

With the use of first and second polypeptide domains, the domains may be located on the same polypeptide molecule or two separate molecules. In many embodiments, the domains are located on separate polypeptide molecules, each of which includes a transmembrane domain or other protein domain that allows for association with a lipid bilayer. A transmembrane domain may also be present in a single polypeptide molecule contain both domains. In some embodiments, the transmembrane domain is the putative transmembrane region of a PRRSV GP5 protein as known to the skilled person and as described herein.

In many embodiments, the domains are located on separate GP5 proteins. In numerous other embodiments, the domains have identical sequences in the conserved GP5 motif, such as that represented by CELNGT (SEQ ID NO:2). But even with an identical conserved GP5 motif, the first and second polypeptide domains differ in the HV2 sequence, which accounts for the desired difference in antigenicity and/or immunogenicity between the domains.

In many embodiments of separate GP5 proteins containing the first and second polypeptide domains, each GP5 protein may comprise, from the N-terminus to the C-terminus, a putative signal sequence, an HV-1 hypervariable region, a conserved region (CR) containing the conserved GP5 motif, the HV-2 hypervariable region, a putative transmembrane region, and the remainder of the GP5 protein. In other embodiments, a GP5 protein may lack all or part of the putative signal sequence. Of course polypeptide molecules retaining the antigenic and/or immunogenic properties of the disclosed polypeptide domains, but with fewer GP5 components, may also be used. Non-limiting examples include a polypeptide molecule comprising the HV-1 hypervariable region, a conserved region (CR) containing the conserved GP5 motif, and the HV-2 hypervariable region, optionally with a transmembrane domain as described above.

Generally, a disclosed HV2 region is about 8 amino acid residues in length. In alternative embodiments, the length may be 6, 7, 8, 9, or 10 residues in length. The exact number of residues is unimportant so long as the resultant domain retains the desired antigenic and/or immunogenic activity. In some embodiments, the HV2 begins with the tripeptide sequence $X_0$WL where $X_0$ is as defined herein. So in some embodiments, the HV2 is represented by the sequence $X_0WLX_1X_2X_3X_4X_5$, wherein each of $X_0$, $X_1$, $X_2$, $X_3$, and $X_4$ is independently one of the 20 naturally occurring amino acid residues shown in Table 1, and $X_5$ is selected from any amino acid residue, with optional exception of C (Cys), F (Phe), M (Met), W (Trp), and P (Pro).

In other embodiments, the HV2 is a D group sequence represented by $X_0WLX_1X_2X_3X_4D$, wherein the aspartic acid (D) residue (at the end of $X_0WLX_1X_2X_3X_4D$) may be replaced by any amino acid residue except C, F, M, P, W, S, T, and Y (such as replacement by A, G, V, L, I, N, E, Q, R, K, or H) and where $X_0$ is as described above, and one of subgroups D-1 through D-8, which are represented by the following D-1: wherein $X_1$ is an aliphatic amino acid residue, $X_2$ is an acidic amino acid residue (or wherein $X_1$ is an acidic amino acid residue and $X_2$ is an aliphatic amino acid residue), $X_3$ is a basic amino acid residue, and $X_4$ is an amino acid residue comprising an aromatic ring, such as phenylalanine (F);

D-2: wherein $X_1$ is an aliphatic amino acid residue, $X_2$ is Ser, Thr, Tyr or an basic amino acid residue (or wherein $X_1$ is Ser, Thr, Tyr or a basic amino acid residue and $X_2$ is an aliphatic amino acid residue), $X_3$ is a basic amino acid residue, and $X_4$ is an amino acid residue comprising an aromatic ring, such as phenylalanine (F);

D-3: wherein each of $X_1$ and $X_2$ is independently an aliphatic amino acid residue, $X_3$ is a basic amino acid residue, and $X_4$ is an amino acid residue comprising an aromatic ring, such as phenylalanine (F);

D-4: wherein $X_1$ is an acidic amino acid residue, $X_2$ is Ser, Thr, Tyr or a basic amino acid residue (or wherein $X_1$ is Ser, Thr, Tyr or a basic amino acid residue and $X_2$ is an acidic amino acid residue), $X_3$ is a basic amino acid residue, and $X_4$ is an amino acid residue comprising an aromatic ring, such as phenylalanine (F);

D-5: wherein each of $X_1$ and $X_2$ is independently an acidic amino acid residue, $X_3$ is a basic amino acid residue, and $X_4$ is an amino acid residue comprising an aromatic ring, such as phenylalanine (F);

D-6: wherein each of $X_1$ and $X_2$ is independently one of the 20 naturally occurring amino acid residues, $X_3$ is an acidic amino acid residue, and $X_4$ is an amino acid residue comprising an aromatic ring, such as phenylalanine (F);

D-7: wherein each of $X_1$ and $X_2$ is independently one of the 20 naturally occurring amino acid residues, $X_3$ is a non-aromatic amino acid residue with a hydroxyl containing R-group (such as Ser or Thr), and $X_4$ is an amino acid residue comprising an aromatic ring, such as phenylalanine (F); or D-8: wherein each of $X_1$ and $X_2$ is independently either a basic amino acid residue or an amino acid residue comprising an aromatic ring, such as tyrosine (Y), serine (S), threonine (T), or phenylalanine (F), $X_3$ is a basic amino acid residue, and $X_4$ is an amino acid residue comprising an aromatic ring, such as phenylalanine (F).

In additional embodiments, the HV2 is an S group sequence represented by $X_0WLX_1X_2X_3X_4X_5$ (where $X_0$ is as described above) and one of subgroups S-1 through S-8, which are represented by the following S-1: wherein $X_1$ is an acidic amino acid residue, $X_2$ is asparagine (N), $X_3$ is a basic amino acid residue, $X_4$ is an amino acid residue comprising an aromatic ring, such as phenylalanine (F), and $X_5$ is S;

S-2: wherein each of $X_1$ and $X_2$ is independently an acidic amino acid residue except that $X_2$ is not asparagine (N), $X_3$ is a basic amino acid residue, $X_4$ is an amino acid residue comprising an aromatic ring, such as phenylalanine (F), and $X_5$ is S;

S-3: wherein $X_1$ is an aliphatic amino acid residue, $X_2$ is an acidic amino acid residue (or wherein $X_1$ is an acidic amino acid residue and $X_2$ is an aliphatic amino acid residue), $X_3$ is a basic amino acid residue, $X_4$ is an amino acid residue comprising an aromatic ring, such as phenylalanine (F), and $X_5$ is S;

S-4: wherein $X_1$ is an aliphatic amino acid residue, $X_2$ is Ser, Thr, Tyr or a basic amino acid residue (or wherein $X_1$ is Ser, Thr, Tyr or a basic amino acid residue and $X_2$ is an aliphatic amino acid residue; or where each of $X_1$ and $X_2$ is independently Ser, Thr, Tyr or a basic amino acid residue; or where each of $X_1$ and $X_2$ is independently an aliphatic amino acid residue), $X_3$ is a basic amino acid residue, $X_4$ is an amino acid residue comprising an aromatic ring, such as phenylalanine (F), and $X_5$ is S;

S-5: wherein $X_1$ is an acidic amino acid residue, $X_2$ is Ser, Thr, Tyr or a basic amino acid residue (or wherein $X_1$ Ser, Thr, Tyr or is a basic amino acid residue and $X_2$ is an acidic amino acid residue except N (Asn)), $X_3$ is a basic amino acid residue, $X_4$ is an amino acid residue comprising an aromatic ring, such as phenylalanine (F), and $X_5$ is S;

S-6: wherein $X_1$ is a basic amino acid residue, $X_2$ is an asparagine (N), $X_3$ is a basic amino acid residue, $X_4$ is an amino acid residue comprising an aromatic ring, such as phenylalanine (F), and $X_5$ is S;

S-7: wherein each of $X_1$ and $X_2$ is independently one of the 20 naturally occurring amino acid residues, $X_3$ is a basic amino acid residue, $X_4$ is an amino acid residue comprising an aromatic ring, such as phenylalanine (F), and $X_5$ is T or Y; or S-8: wherein $X_1$ is an acidic amino acid residue, $X_2$ is an acidic amino acid residue (or wherein $X_1$ is an acidic amino acid residue and $X_2$ is an aliphatic amino acid residue, or alternatively wherein $X_1$ is an aliphatic amino acid residue and $X_2$ is an acidic amino acid residue), $X_3$ is an acidic amino acid residue, $X_4$ is an amino acid residue comprising an aromatic ring, such as phenylalanine (F), and $X_5$ is S.

In yet additional embodiments, the HV2 is an E group sequence represented by one of subgroups E-1 through E-8 as follows:

the sequence $NWLSX_2X_3X_4X_5$ (represented by E-1), wherein each of $X_2$, $X_3$, and $X_4$ is independently one of the 20 naturally occurring amino acids, and $X_5$ is an acidic or aliphatic amino acid residue;

the sequence $X_0WLX_1X_2X_3X_4X_5$ (represented by E-2), wherein $X_0$ is an acidic amino acid residue except for asparagine (N), each of $X_1$, $X_2$, $X_3$, and $X_4$ is independently one of the 20 naturally occurring amino acid residues, and $X_5$ is an acidic or aliphatic amino acid residue;

the sequence $X_0WLX_1X_2X_3X_4X_5$ (represented by E-3), wherein $X_0$ is a basic amino acid residue, each of $X_1$, $X_2$, $X_3$, and $X_4$ is independently one of the 20 naturally occurring amino acid residues, and $X_5$ is an acidic or aliphatic amino acid residue;

the sequence $X_0WLX_1X_2X_3X_4X_5$ (represented by E-4), wherein $X_0$ is any non-acidic and non-basic amino acid residue, each of $X_1$, $X_2$, $X_3$, and $X_4$ is independently one of the 20 naturally occurring amino acid residues, and $X_5$ is an acidic or aliphatic amino acid residue;

the sequence $NWLSX_2X_3X_4X_5$ (represented by E-5), wherein each of $X_2$, $X_3$ and $X_4$ is independently one of the 20 naturally occurring amino acid residues, and $X_5$ is Serine (S) or Threonine (T);

the sequence $X_0WLX_1NX_3X_4X_5$ (represented by E-6), wherein $X_0$ is any amino acid residue except asparagine (N), each of $X_1$, $X_3$, and $X_4$ is independently one of the 20 naturally occurring amino acid residues, and $X_5$ is Serine (S) or Threonine (T);

the sequence $X_0WLX_1X_2X_3X_4X_5$ (represented by E-7), wherein $X_0$ is an acidic amino acid residue except asparagine (N), each of $X_1$, $X_2$, $X_3$, and $X_4$ is independently one of the 20 naturally occurring amino acid residues except that $X_2$ is not asparagine (N), and $X_5$ is any non-acidic amino acid residue; or the sequence $X_0WLX_1X_2X_3X_4X_5$ (represented by E-8), wherein $X_0$ is any non-acid amino acid residue, each of $X_1$, $X_2$, $X_3$, and $X_4$ is independently one of the 20 naturally occurring amino acid residues, and $X_5$ is any non-acidic amino acid residue.

The term "non-acidic" refers to an amino acid residue other than an acidic amino acid; and the term "non-basic" refers to an amino acid residue other than a basic amino acid.

In embodiments of separate polypeptide molecules containing the first and second polypeptide domains, the polypeptide molecules may be administered together or separately in the methods disclosed herein. When administered together, they may be formulated as a composition. Optionally, the composition comprises one or more acceptable carriers or excipients or adjuvants as desired by the skilled person.

Methods of Preparation

The disclosure includes a method of preparing polypeptide domains and polypeptide molecules as described herein. In some embodiments, a peptide or short polypeptide may be prepared by use of de novo synthesis, such as by automated chemical methods known to the skilled person. Alternatively, the preparation may be by use of recombinant DNA methods based upon the availability of nucleic acid molecules encoding the polypeptide domains and polypeptide molecules of the disclosure. The sequences of the nucleic acid molecules may be modified by known techniques, such as, but not limited to, PCR-based mutagenesis and de novo synthesis of nucleic acid molecules, such as by automated chemical methods known to the skilled person.

A method based upon the use of recombinant DNA techniques may be used to produce a disclosed polypeptide. Such a method may comprise expressing a nucleic acid molecule in a suitable expression system, such as an in vitro cell culture system or in a producer animal, and isolating the expressed polypeptide from the expression system. The expression system may comprise a nucleic acid sequence encoding a disclosed polypeptide and operably linked to a suitable regulatory or promoter sequence. Non-limiting examples of a suitable cell or cell line include porcine alveolar macrophages, CRL 11171, MA-104, MARC-145, PSP-36, and PSP-36-SAH. A non-limiting example of a producer animal is a pig, such as a boar, sow, fattener, or gilt.

After producing a disclosed polypeptide domain, the method may comprise selecting and/or combining it as a first polypeptide domain with a second polypeptide domain as described herein to form a composition. The combining may comprise adding one or more acceptable carriers, excipients and/or adjuvants to form a composition.

In some embodiments, such as with a PRRSV based nucleic acid molecule, the expression system produces viral particles that incorporate a disclosed polypeptide within the particle's outer membrane. The PRRSV based nucleic acid molecule may be a viral genome that has been modified to express a GP5 protein containing an HV2 region as disclosed herein. In further embodiments, the nucleic acid molecule contains more than one copy of a GP5 protein encoding sequence, where each copy encodes a different HV2 region as described herein. In other embodiments, the expression system is cell-free, such as in the case of a rabbit reticulocyte system.

Other methods of producing PRRSV particles are also provided. In some embodiments, the production comprises selection and/or isolation of PRRSV isolates as described herein. The selection and/or isolation may comprise culturing or passaging an isolate as known to the skilled person or as described herein. In alternative embodiments, the selection may be of an isolate from an infected subject, such as a pig, and further comprise obtaining infectious fluid and/or tissue from the subject for use as a source of an HV2 region as described herein. Non-limiting examples of an infectious fluid and/or tissue include blood, serum, plasma, nasal secretion, semen, seminal fluid, and urine as well as lung tissue, tonsil tissue, lymph node tissue, a fluid component of feces or a fluid extract of feces. In some embodiments, the infectious fluid and/or tissue may be used as part of a disclosed combination. Non-limiting examples include use of a fluid or tissue as an inoculum in combination with a second HV2 region, optionally in a polypeptide molecule or a viral particle as described herein.

Methods of Use

The disclosure includes a method of generating an antibody or immune response in a subject via administration of a disclosed combination of first and second polypeptide domains. In some embodiments, the method comprises administration of a disclosed composition in an amount effective to produce an antibody and/or immune response. In many cases, the administered amount is effective to produce a protected state in a treated subject against a subsequent challenge by one or more PRRSV isolates, such as infection by PRRSV. In some cases, a method may further comprise an additional administration of a disclosed composition as a "booster". Non-limiting examples of the subject include a sow, a gilt, a pregnant sow, or a pregnant gilt. In some embodiments, the subject is a pig from about 1 to 12 weeks in age, such as about 2, about 3, about 4, about 5, about 6, about 7, about 8, about 9, about 10, or about 11 weeks. In other embodiments, the pig is from about 12 to about 56 weeks or older in age, such as about 14, about 16, about 18, about 20, about 22, about 24, about 26, about 28, about 30, about 32, about 34, about 36, about 38, about 40, about 42, about 44, about 46, about 48, about 50, about 52, or about 54 weeks. In additional embodiments, the pig has been weaned and/or has passed the stage at which maternal antibodies provide adequate protection.

An effective amount of a disclosed combination or composition, as a vaccine, to produce a protected state in a subject, such as a pig, may also be determined by administration of the vaccine to an unaffected pig, followed by challenge with PRRSV isolate. In some cases, the isolate may be purified or isolated in that its virus particles have the same genome or the same GP5 protein or the same GP5 ectodomain. Non-limiting examples of isolates for use in a challenge include those listed in FIG. 3 as well as an infectious bodily fluid or tissue from an animal infected with the isolate. In some embodiments, the challenge may be after about 3 to about 8 weeks after a booster vaccination, and may be with a large or excess amount of PRRSV.

The vaccine or amount thereof is effective if it reduces the severity of any symptoms of PRRSV infection and/or any gross or histopathological change when compared to the results of challenging a non-vaccinated (untreated with the vaccine) pig with the same isolate. Of course the pig should be PRRSV-free, such as a pig that has not been previously exposed to the virus or which has been exposed but symptom-free for a sufficient period of time to identify it as uninfected. Alternatively, the pig may be identified as uninfected by use of an assay to detect the presence of PRRSV or anti-PRRSV antibody in a bodily fluid or tissue sample from the pig.

Non-limiting examples of symptoms of PRRSV infection include fever, respiratory distress, cyanosis, pneumonia, lethargy, sneezing, coughing, eye edema, blue ears, and heart and/or brain lesions. Additionally, the presence of the isolate used in the challenge may be determined by other quantitative or qualitative methods. Non-limiting examples include detection of lung lesions, or virus in a blood or serum sample, in a challenged pig, with or without vaccination, after about 2 days to about 2 weeks. A decrease in lesions in a vaccinated pig, in comparison to an untreated pig, provides a quantitative means to detect infection. Alternatively, detection of virus in the blood or serum of a vaccinated pig indicates that the vaccination may not have been effective while a negative detection of virus indicates that the vaccination may have been effective.

The effective stimulation of immunoprotection in a subject may be mediated by the generation of an antibody and/or immune response after exposure to a combination or composition of the disclosure. Non-limiting examples of the subject may be a pig that has not been previously exposed to PRRSV or a pig that has been exposed to PRRSV or suffering the effects from PRRSV infection. In many embodiments, the production of an antibody response includes the production of neutralizing antibodies against the GP5 protein, including all or part of the HV2 therein. Confirmation of the generation of such antibodies may be performed by assaying blood or serum from a treated animal for the presence of such antibodies. Non-limiting examples of such antibody detection assays include ELISA, RIA, and Western blotting.

The disclosure includes a method of producing an antibody and/or immune response in a subject as described herein. In some embodiments, the method comprises at least i) identifying or selecting a first PRRSV isolate comprising a polypeptide molecule containing a first HV-2 hypervariable region; ii) identifying or selecting a second PRRSV isolate comprising a polypeptide molecule containing a second HV-2 hypervariable region different from said first hypervariable region; and iii) administering the first and second isolates to a subject to produce an antibody and/or immune response in said subject. In some embodiments, the method may include selection of one or more additional isolates with additional different HV-2 regions followed by their administration with the first and second isolates. In other embodiments, the method may include administration of one or more unselected isolates with the first and second isolates.

The amount of the first and second isolates to administer should of course be sufficient to produce a desired antibody and/or immune response. In some embodiments, the administered amount is sufficient to produce a vaccinated or protected state in the subject against subsequent PRRSV infection by one or more isolates.

In some cases, the identifying or selecting may comprise i) amino acid sequence analysis of the PRRSV GP5 ectodomain HV-2 hypervariable region; ii) PCR-based or antibody-based detection of the PRRSV GP5 ectodomain HV-2 hypervariable region; or iii) knowing the PRRSV GP5 ectodomain HV-2 hypervariable region sequence relative to another isolate.

In other embodiments, a method of producing an antibody and/or immune response comprises administration of a first polypeptide (antigenic) domain comprising an HV-2 region selected from D-1, D-2, D-3, D-4, D-5, D-6, D-7, or D-8, and a second polypeptide (antigenic) domain comprising an HV-2 region selected from S-1, S-2, S-3, S-4, S-5, S-6, S-7, or S-8. In many cases, the combination with two or more different polypeptides (antigenic) domains selected from D-1, D-2, D-3, D-4, D-5, D-6, D-7, D-8, S-1, S-2, S-3, S-4, S-5, S-6, S-7 and S-8 is advantageously used in North America.

In other embodiments, the administration comprises two or more polypeptide (antigenic) domains selected from E-1, E-2, E-3, E-4, E-5, E-6, E-7, and E-8. In many cases, this combination is advantageously used in Europe. In additional embodiments, a combination of two or more different polypeptide (antigenic) domains may be selected from the 24 subgroups depending on the PRRSV isolates found in a particular geographic regions. Non-limiting examples include the isolates found in South Korea, China, Japan, Southeast Asia, or South America. In additional embodiments, a combination used in S. Korea, China, or Japan may be the same as one used in North America. In other embodiments, a domain of any of E-1, E-2, E-3, E-4, E-5, E-6, E-7, and E-8 may be excluded from a combination of domains for use in North America or an Asian location.

In further embodiments, a combination of two or more polypeptide (antigenic) domains, or polypeptide molecules or isolates containing them, comprising at least one from each of subgroups detected at a geographic region may be administered in the practice of the disclosure. Administration of the polypeptide (antigenic) domains, or polypeptide molecules or isolates containing them, may be by any suitable means known to the skilled person. Non-limiting examples include injection, intranasal administration, or oral administration, of one or more disclosed isolates or of one or more sample of cells and/or tissue from a PRRSV infected subject.

If administered or applied separately, the domains, or polypeptide molecules or isolates containing them, may be sequentially administered, with an optional time interval between administrations. Non-limiting examples of the time interval include about 1 to about 2 days; about 1, about 3, or about 5 weeks; about 1, about 3, about 4 or about 6 months, or longer. The same time intervals may be used in between a primary administration event and one or more subsequent "booster" events.

Whether administered together or separately, the polypeptide molecule(s) may be membrane bound or membrane associated, such by association with a lipid bilayer. In some cases, the membrane is from a cell, such as a fragment of a cellular membrane. In other embodiments, the membrane is that of a vesicle, such as a liposome, oil-in-water or water-in oil suspension. Non-limiting examples of a cell derived membrane include the outer membrane of a PRRSV particle or other viral particle as described herein.

Kits

The polypeptide domains, polypeptide molecules, and isolates, as well as combinations and compositions comprising them and their methods of use may be embodied in one or more kits produced in accordance with well known procedures. The disclosure thus includes a kit with one or more reagents comprising one or more polypeptide domains, polypeptide molecules, or isolates, as described herein, or a combination or composition comprising them, for use in one or more methods as disclosed herein. Such a kit optionally further comprises an identifying description or label or instructions relating to their its use in one or more method of the present disclosure. Such a kit may comprise containers, each with one or more of the various reagents (typically in concentrated form) utilized in the methods. A set of instructions will also typically be included.

Having now generally described the invention, the same will be more readily understood through reference to the following examples which are provided by way of illustration, and are not intended to be limiting of the present disclosure, unless specified.

EXAMPLES

Example 1

Failure of Conserved GP5 Sequence to Generate Protected State

The disclosure is based in part upon the recognition that pigs previously infected with a first isolate of PRRSV can recover but be susceptible to a second isolate where both isolates contain a GP5 protein with the same sequence in the Conserved Region. Non-limiting examples of such incidents are shown in Table 2 below, where each incident involved pigs that recovered from infection with one of the identified isolates (the first of each incident set in the table) were then found to be infected with at least one other isolate (the second of each of incidents 1-3 and 5-7) as indicated. A portion of the GP5 sequence including the ectodomain in each of the isolates is indicated, with the Conserved Region as identified in FIG. 1 underlined and differences in the HV2 region indicated in bold.

TABLE 2

| Incident/ Isolates | Relative position number in GP5 protein<br>21 31 41 51 61 |
|---|---|
| #1 | |
| Q-05-30318 | VPFCFVALVN ASNNSSSHLQ LIYNLTICEL NGTDWLNKSF D (Group D-7); Seq ID No: 1765 |
| Q-06-15248 | VPFCFVALVN ASNNSSSHLQ LIYNLTICEL NGTDWLNK**N**F D (Group D-6); Seq ID No: 1766 |
| #2 | |
| I-03-28077 | VPFCFVALVN ASNNSSSHLQ LIYNLTICEL NGTDWLNKSF D (Group D-7); Seq ID No: 1767 |
| I-04-32332 | VPFCFVALVN ASNNSSSHLQ LIYNLTICEL NGTDWL**DKT**F D (Group D-7); Seq ID No: 1768 |
| #3 | |
| S-06-20709 | VPFCLAALVN ADSNSSSHLQ LIYNLTICEL NGTDWLNNHF S (Group S-1); Seq ID No: 1769 |
| S-06-20720 | VPFCLAALVN ADSNSSSHLQ LIYNLTICEL NGTDWLNN**R**F **G** (Group D-5); Seq ID No: 1770 |
| #4 | |
| M-05-2912 | VPFCFAVLAN ASNNSSSHLQ LIYNLTLCEL NGTDWLANKF D (Group D-1); Seq ID No: 1771 |
| M-06-13702 | VPFCLVALVN ANSNNSSHLQ LIYNLTICEL NGTDWLN**RH**F S (Group S-5); Seq ID No: 1772 |
| M-06-18282 | VPFCLVALVN ANSNNSSHLQ LIYNLTICEL NGTDWLN**EH**F S (Group S-2); Seq ID No: 1773 |
| #5 | |
| H-04-10314 | VPFCFAALVN ASNNSSSHLQ LIYNLTICEL NGTDWLNEHF S (Group S-2); Seq ID No: 1774 |
| H-06-14421 | VPFCFVALVN ASNNSSSHLQ LIYNLTICEL NGTDWLN**KN**F D (Group D-6); Seq ID No: 1775 |
| #6 | |
| A-00-19757 | VPFXFAVIVN ANNNSSSHFQ LIYNLTLCEL NGTEWLNKKF D (Group D-4); Seq ID No: 1776 |
| A-00-53953 | VPFWFAVLVD ANSNSSSHFQ LIYNLTICEL NGTDWLN**N**KF D (Group D-5); Seq ID No: 1777 |
| #7 | |
| G-00-3628 | VPSCFVAPVN ANDNNSSKLQ LIYNLTLCEL NGTDWLAGKF D (Group D-3); Seq ID No: 1778 |
| G-05-6157 | VPFCFAVIVN ASNNSSSHFQ LIYNLTLCEL NGTDWLA**E**HF N (Group D-1); Seq ID No: 1779 |

Based upon a study of such incidents, a discovery was made that antibodies directed against the Conserved Region in a GP5 protein of an isolate are insufficient to provide protection against a subsequent PRRSV. Additionally, the sequences of the HV-1 region did not provide an adequate explanation for the incidents. A majority of the incidents shown include no change in the HV1 sequence. This led to the discovery that the sequence variation in the HV-2 region participates in evading the immune surveillance of an animal previously exposed to a PRRSV with a different sequence in the HV-2 region. Stated differently, the conserved sequence in the GP5 ectodomain as shown above is unable to produce an antibody or immune response that is protective against another PRRSV with a different HV-2 region in the GP5 protein.

This discovery led, in part, to the disclosed combinations, compositions, and methods.

Example 2

Propagation of PRRSV Isolates

Methods for the propagation and maintenance of PRRSV isolates has been previously reported (see for example Meng et al., 1994, *J. Gen. Virol.* 75:1795-1801 and Meng et al., 1996, *J. of Vet. Diag. Invest.* 8:374-381). Non-limiting examples include the use of cell line ATCC CRL 11171, which can be grown in monolayers suitable for inoculation with a viral isolate. Alternative cells and cell lines include MA-104, PSP-36, PSP-36-SAH, MARC-145 and porcine alveolar macrophages.

As a non-limiting example, a multiplicity of infection (moi) of about 0.1, 0.5, or 1 may be used followed by incubation for about 48 hours prior to confirmation of infection and viral replication. Confirmation may be by removal of supernatant (culture media) and fixing the cells followed by detection with a labeled anti-PRRSV antibody, such as a monoclonal antibody specific for the N protein (encoded by ORF 7) or an antibody against a particular HV2 region of a GP5 protein as described herein.

Example 3

Virus Isolate Combinations

As described herein, PRRSV isolates may be classified (identified) and selected for use in a combination of the disclosure at least on the basis of the HV2 sequence. The following data shows a portion of the GP5 sequence (including the ectodomain) in each of numerous representative PRRSV isolates, some of which differ in regions outside the ectodomain. The locations of the HV 1, conserved region (CR), and HV2 as described herein are indicated at the bottom of the data, with the indication of the start of the HV 1 being a non-limiting representative example.

The classification of the sequences into the disclosed Groups is included, and combinations of isolates from different subgroups may be used in the practice of the disclosure. So as one non-limiting example, a combination of a D-4 isolate (Ingelvac-ATP), a D-1 isolate (Ingelvac-MLV or one of MJ-3 to MJ-14), an S-1 isolate (MJ-1 or MJ-2), and a D-3 isolate (MJ-15 or MJ-16) may be used to produce an immune response in a subject as disclosed herein.

Another non-limiting example is a combination of a D-1 isolate (one of MJ-17 to MJ-27), a D-6 isolate (one of MJ-28 to MJ-30), a D-2 isolate (MJ-34 or MJ-35), and a D-3 isolate (such as MJ-36). All other combinations of isolates represented by the data below, and in accordance with the disclosure, are specifically contemplated for preparation and use as described herein.

| All Strains including European Strain (LV) | |
|---|---|
| Ingelvac-ATP | LVNANSNSSSHLQLIYNLTLCELNGTDWLKDKFD (Group D-4); Seq ID No: 188) |
| VR-2332 | LANASNDSSSHLQLIYNLTLCELNGTDWLANKFD (Group D-1); Seq ID No: 47) |
| Ingelvac-MLV | LANASNDSSSHLQLIYNLTLCELNGTDWLANKFD (Group D-1); Seq ID No: 47) |
| Prime-Pac | LVNASYSSSSHLQLIYNLTLCELNGTDWLANKFD (Group D-1); Seq ID No: 48) |
| MJ-1 | LANASSNSSSHLQLIYNLTICELNGTDWLNNHFS (Group S-1); Seq ID No: 1780) |
| MJ-2 | LANANSNSSSHLQLIYNLTICELNGTDWLNNHFS (Group S-1); Seq ID No: 1781) |
| MJ-3 | LANASNDSSSHLQLIYNLTLCELNGTDWLANKFD (Group D-1); Seq ID No: 47) |
| MJ-4 | LANASNGSSSHLQLIYNLTLCELNGTDWLANKFD (Group D-1); Seq ID No: 75) |
| MJ-5 | LANASNHSSSHLQLIYNLTLCELNGTDWLANKFD (Group D-1); Seq ID No: 1142) |
| MJ-6 | LANASNNSSSHLQLIYNLTLCELNGTDWLANKFD (Group D-1); Seq ID No: 055) |
| MJ-7 | LASASNSSSSHLQLIYNLTLCELNGTDWLANKFD (Group D-1); Seq ID No: 1782) |
| MJ-8 | LATPSPSSSSHLQLIYNLTLCELNGTDWLANKFD (Group D-1); Seq ID No: 1783) |
| MJ-9 | LANASNANSSHLQLIYNLTLCELNGTDWLANKFD (Group D-1); Seq ID No: 1784) |
| MJ-11 | LANASNVNSSHLQLIYNLTLCELNGTDWLANKFD (Group D-1); Seq ID No: 1785) |
| MJ-12 | LANASNDNSSHLQLIYNLTLCELNGTDWLANKFD (Group D-1); Seq ID No: 1786) |
| MJ-13 | LANASNSNSSHLQLIYNLTLCELNGTDWLANKFD (Group D-1); Seq ID No: 1787) |
| MJ-14 | LANASNSNSSHLQLIYNLTLCELNGTDWLADKFD (Group D-1); Seq ID No: 1788) |
| MJ-15 | LANASNGNSSHLQLIYNLTLCELNGTDWLAGKFD (Group D-3); Seq ID No: 1789) |
| MJ-16 | LANASNSSNSHLQLIYNLTLCELNGTDWLAGKFD (Group D-3); Seq ID No: 1790) |
| MJ-17 | LANASNDSSSHLQLIYNLTLCELNGTDWLADKFD (Group D-1); Seq ID No: 1791) |
| MJ-18 | LANASNTSSSHLQLIYNLTLCELNGTDWLADKFD (Group D-1); Seq ID No: 1792) |
| MJ-19 | LANASNNSSSHLQLIYNLTLCELNGTDWLADKFD (Group D-1); Seq ID No: 484) |
| MJ-20 | LANANNTSSSHLQLIYNLTLCELNGTDXLAEKFD (Group D-1); Seq ID No: 1793) |
| MJ-21 | LANANNSSSSHLQLIYNLTLCELNGTDWLANKFD (Group D-1); Seq ID No: 1794) |
| MJ-22 | LANASNNSSSHLQLIYNLTLCELNGTDWLANQFD (Group D-6); Seq ID No: 1337) |
| MJ-23 | LANASSNSSSHLQLIYNLTLCELNGTDWLANKFD (Group D-1); Seq ID No: 1795) |
| MJ-24 | LANASANSSSHLQLIYNLTLCELNGTDWLANKFD (Group D-1); Seq ID No: 61) |
| MJ-25 | LANASHNSSSHLQLIYNLTLCELNGTDWLANKFD (Group D-1); Seq ID No: 508) |
| MJ-26 | LANASQNSSSHLQLIYNLTLCELNGTDWLANKFD (Group D-1); Seq ID No: 1796) |
| MJ-27 | LANASSNSSSHLQLIYNLTLCELNGTDWLANRFD (Group D-1); Seq ID No: 1797) |
| MJ-28 | LANASSDNSSHLQLIYNLTLCELNGTDWLANNFD (Group D-6); Seq ID No: 1798) |
| MJ-29 | LANASSDNSSHLQLIYNLTLCELNGTDWLANNFD (Group D-6); Seq ID No: 1798) |
| MJ-30 | LASANSINSPHLQLIYNLTLCELNGTDWLAGEFD (Group D-6); Seq ID No: 1799) |

-continued

| All Strains including European Strain (LV) | |
|---|---|
| MJ-31 | LASASNNSSSRLQLIYNLTLCELNGTDWLADRFN (Group D-1); Seq ID No: 1800) |
| MJ-32 | LADAHSSSSSHLQLIYNLTLCELNGTDWLADRFD (Group D-1); Seq ID No: 1801) |
| MJ-33 | LANAGNNSSSHLQLIYNLTLCELNGTEWLAERFD (Group D-1); Seq ID No: 1802) |
| MJ-34 | LGSASSNSSSHFQLIYNLTLCELNGTDWLASRFD (Group D-2); Seq ID No: 1803) |
| MJ-35 | LVDANNSSSSHFQLIYNLTICELNGTDWLKARFD (Group D-2); Seq ID No: 1804) |
| MJ-36 | LVDANNSSSSHFQLIYNLTICELNGTDWLAARFD (Group D-3); Seq ID No: 1805) |
| MJ-37 | LVDANGNSSSHLQLIYNLTLCELNGTDWLANRFD (Group D-1); Seq ID No: 1806) |
| MJ-38 | LVNANSTSSSHIQLIYNLTLCELNGTDWLGDKFD (Group D-1); Seq ID No: 1807) |
| MJ-39 | LVNANSSSSSHIQLIYNLTLCELNGTDWLTNKFD (Group D-4); Seq ID No: 1453) |
| MJ-40 | LVNANSSSSSHLQSIYNLTLCELNGTDWLGNKFD (Group D-1); Seq ID No: 1808) |
| MJ-41 | LVDANSSSSSHFQLIYNLTLCELNGTDWLNDKFD (Group D-5); Seq ID No: 1809) |
| MJ-42 | LVDANSSSSSHFQLIYNLTLCELNGTDWLNEKFD (Group D-5); Seq ID No: 1810) |
| MJ-43 | LVNANSSSSSHFQLIYNLTLCELNGTDWLNEKFD (Group D-5); Seq ID No: 1811) |
| MJ-44 | LVNANSSSSSHFQLIYNLTLCELNGTDWLADKFD (Group D-1); Seq ID No: 44) |
| MJ-45 | LVNANSSSSSHFQLIYNLTLCELNGTDWLGNKFD (Group D-1); Seq ID No: 464) |
| MJ-46 | LANANSSSSSHFQLIYNLTLCELNGTDWLDKKFD (Group D-4); Seq ID No: 1812) |
| MJ-47 | LVNANSASSSHSQLIYNLTLCELNGTDWLDGKFE (Group D-1); Seq ID No: 1813) |
| MJ-48 | LVNANSASSSHSQLIYNLTLCELNGTDWLAGKFE (Group D-3); Seq ID No: 1814) |
| MJ-49 | LVNANSTSSSPFQLIYNLTLCELNGTDWLQGKFN (Group D-1); Seq ID No: 1815) |
| MJ-50 | IANASSNSSSHIQLIYNLTLCELNGTDWLAGKFD (Group D-3); Seq ID No: 1816) |
| MJ-51 | IVNANSNSSSHIQLIYNLTLCELNGTDWLADKFD (Group D-1); Seq ID No: 952) |
| MJ-52 | IVNANSNSSSHFQLIYNLTLCELNGTDWLANKFD (Group D-1); Seq ID No: 1817) |
| MJ-53 | VVNANSNSSSHFQSIYNLTLCELNGTKWLATKFD (Group D-2); Seq ID No: 1818) |
| MJ-54 | LDNANSTSSSHFQSIYNLTLCELNGTEWLAENFD (Group D-6); Seq ID No: 1819) |
| MJ-55 | LDNANSTSSSHFQSIYNLTLCELNGTKWLAEHFD (Group D-1); Seq ID No: 1820) |
| MJ-56 | LVNANSTSSSHFQSIYNLTLCELNGTDWLKEKFD (Group D-4); Seq ID No: 1821) |
| MJ-57 | LVDANSSSSSHFQSIYNLTLCELNGTDWLTERFD (Group D-4); Seq ID No: 1822) |
| MJ-58 | LVNANSNSSSHFQLIYNLTLCELNGTDWLAQKFD (Group D-1); Seq ID No: 1757) |
| MJ-59 | LVNANSNSSSHFQLIYNLTLCELNGTDWLAKKFD (Group D-2); Seq ID No: 572) |
| MJ-60 | LVDANSNSSSHFQLIYNLTLCELNGPDWLKKNFD (Group D-6); Seq ID No: 1823) |
| MJ-61 | LVNANSNSSSHFQLIYNLTLCELNGTDWLKEKFD (Group D-4); Seq ID No: 571) |
| MJ-62 | LVGANGNSSSHFQLIYNLTLCELNGTDWLDEKFD (Group D-5); Seq ID No: 1824) |
| MJ-63 | LVNASSNSSSHFQLIYNLTLCELNGTDWLKNKFD (Group D-4); Seq ID No: 1825) |
| MJ-64 | LVNAHSNSSSHFQSIYNLTLCELNGTDWLDKKFD (Group D-4); Seq ID No: 1826) |
| MJ-65 | LVNAHDNSSSHFQLIYNLTLCELNGTDWLNKKFD (Group D-4); Seq ID No: 1827) |
| MJ-66 | LVNASNTSSSYFQSIYNLTLCELNGTDWLKDKFD (Group D-4); Seq ID No: 1828) |
| MJ-67 | LVNASNSSSSHFQLIYNLTLCELNGTDWLQGKFD (Group D-1); Seq ID No: 1829) |
| MJ-68 | IVNASNSNSSHLQSIYSLTLCELNGTEWLGKNFD (Group D-6); Seq ID No: 1830) |
| MJ-69 | LVNANNSSSSHFQSIYNLTLCELNGTEWLAKNFN (Group D-6); Seq ID No: 1831) |
| MJ-70 | LVNASSNNSSHFQLIYNLTLCELNGTEWLAKNFI (Group D-6); Seq ID No: 1832) |
| MJ-71 | LVNANSSSSSHLQLIYNLTLCELNGTDWLKDKFD (Group D-4); Seq ID No: 473) |
| MJ-72 | LVNANSNSSSHLQLIYNLTLCELNGADWLKDKFA (Group D-4); Seq ID No: 1833) |
| MJ-73 | LVNASNSNSSHLQLIYNLTLCELNGTDWLGNKFN (Group D-1); Seq ID No: 1834) |
| MJ-74 | LVNANSNNSSHLQLIYNLTLCSLNGTDWLANKFD (Group D-1); Seq ID No: 1365) |
| MJ-75 | LASANNNHSSHLQSIYNLTLCELNGTDWLSDKFD (Group D-4); Seq ID No: 1835) |
| MJ-76 | LASANGNHSSHLQSIYNLTLCELNGTDWLRSRFS (Group S-4); Seq ID No: 1836) |
| MJ-77 | LVGASNTSSSHFQLIYNLTLCELNGTDWLNNHFY (Group S-7); Seq ID No: 1837) |
| MJ-78 | IVDANSNSSSHFQLIYNLTLCELNGTDWLNNHFN (Group D-5); Seq ID No: 1838) |
| MJ-79 | LVDANSNSSSHFQLIYNLTLCELNGTDWLNNHFT (Group S-7); Seq ID No: 804) |
| MJ-80 | PVNANNGSSSYSQLIYNLTICELNGTDWLNSKFD (Group D-4); Seq ID No: 1839) |
| MJ-81 | PVNANNGTSSYSQLIYNLTICELNGTEWLGSKFD (Group D-2); Seq ID No: 1840) |
| MJ-82 | LVNAANTSSSYSQLIYNLTLCELNGTDWLVNRFD (Group D-1); Seq ID No: 1841) |
| MJ-83 | LANANNTSSSYSQLIYNLTLCELNGTDWLVGKFE (Group D-3); Seq ID No: 1842) |
| MJ-84 | LANANSTSSSYSQLIYNLTICELNGTDWLDDNFD (Group D-6); Seq ID No: 1843) |
| MJ-85 | LVNANSSSSSYSQLIYNLTLCELNGTDWLDKKFY (Group S-7); Seq ID No: 1844) |
| MJ-86 | LVNANNTSSSYSQLIYNLTLCELNGADWLKEHFS (Group S-5); Seq ID No: 1845) |
| MJ-87 | LVNANNTNSSYSQLIYNLTLCELNGTDWLKGHFS (Group S-4); Seq ID No: 1846) |
| MJ-88 | LVNANSTSSSYSQLIYNLTLCELNGTEWLGNSFN (Group D-7); Seq ID No: 1847) |
| MJ-89 | LVNANSTSSSYSQLIYNLTLCELNGTEWLGTKFS (Group S-4); Seq ID No: 1848) |
| MJ-90 | LVNANSTSSSYSQLIYNLTLCELNGTEWLGEKFS (Group S-3); Seq ID No: 1849) |
| MJ-91 | LVNANSTNSSYSQLIYNLTLCELNGTEWLGKNFS (Group S-8); Seq ID No: 1850) |
| MJ-92 | LVNANSTNSSYSQLIYKLTLCELNGTEWLGKKFS (Group S-4); Seq ID No: 1851) |
| MJ-93 | LVNANSTSSSYSQLIYNLTLCELNGTDWLNEKFS (Group S-2); Seq ID No: 1852) |
| MJ-94 | LVNANSTSSSYSQLIYNLTLCELNGTDWLNDKFS (Group S-2); Seq ID No: 1853) |
| MJ-95 | LVNANSTSSSYSQLIYNLTLCELNGTDWLDGHFS (Group S-3); Seq ID No: 1854) |
| MJ-96 | LVNANSTSSSYSQLIYNLTICELNGTDWLNGQFS (Group S-3); Seq ID No: 1855) |
| MJ-97 | LVNANNTSSSYSQLIYNLTICELNGTDWLNGRFS (Group S-8); Seq ID No: 1856) |
| MJ-98 | LVNANNTSSSYSQLIYNLTICELNGTDWLNGKFS (Group S-3); Seq ID No: 1857) |
| MJ-99 | LVNANSTSSSYSQLIYNLTICELNGTDWLNEHFS (Group S-2); Seq ID No: 1858) |
| MJ-100 | LVNASNNSSSYSQLIYNLTLCELNGTDWLNKKFS (Group S-5); Seq ID No: 1859) |
| MJ-101 | LVNASNNSSSHLQLIYNLTICELNGTDWLDKTFD (Group D-7); Seq ID No: 1860) |
| MJ-102 | LVNASNNSSSHLQLIYNLTICELNGTDWLDKSFD (Group D-7); Seq ID No: 1861) |
| MJ-103 | LVNASNNSSSHLQLIYNLTICELNGTDWLNKTFD (Group D-7); Seq ID No: 1862) |
| MJ-104 | LVNASNNSSSHLQLIYNLTICELNGTDWLNKSFD (Group D-7); Seq ID No: 878) |
| MJ-105 | LVNASNNSSSHLQLIYNLTICELNGTDWLNRSFD (Group D-7); Seq ID No: 1863) |
| MJ-106 | LVNASNNSSSHLQLIYNLTICELNGTDWLNFSFD (Group D-7); Seq ID No: 1864) |
| MJ-107 | LVNASNNSSSHLQLIYNLTICELNGTDWLSNNFD (Group D-6); Seq ID No: 1865) |
| MJ-108 | LVNASNNGSSHLQLIYNLTICELNGTDWLNNTFD (Group D-7); Seq ID No: 1866) |

-continued

| All Strains including European Strain (LV) | |
|---|---|
| MJ-109 | LVNANSNSSSHLQLIYNLTICELNGTDWLNDHFS (Group S-2); Seq ID No: 1668) |
| MJ-110 | LVNANSNSSSHLQLIYNLTICELNGTDWLNFHFS (Group S-2); Seq ID No: 768) |
| MJ-111 | LVNANSNSSSHLQLIYNLTICELNGTDWLNSHFS (Group S-5); Seq ID No: 461) |
| MJ-112 | LVNAHSNSSSHLQLIYNLTICELNGTDWLNKHFS (Group S-5); Seq ID No: 949) |
| MJ-113 | LVNANSSNSSHLQLIYNLTICELNGTDWLNNHFS (Group S-1); Seq ID No: 1073) |
| MJ-114 | LVNASNDSSSHLQLIYNLTICELNGTDWLNGHFS (Group S-3); Seq ID No: 1867) |
| MJ-115 | LVNASNSSSSNLQLIYNLTICELNGTDWLKNHFS (Group S-5); Seq ID No: 1868) |
| MJ-116 | LVNASSNSSSHLQLIYNLTICELNGTDWLFNHFS (Group S-1); Seq ID No: 939) |
| MJ-117 | LVNANSNSSSHLQLIYNLTICELNGTDWLKNHFS (Group S-5); Seq ID No: 1022) |
| MJ-118 | LVNANSNSSSNLQLIYNLTICELNGTEWLGSHFS (Group S-4); Seq ID No: 1869) |
| MJ-119 | LVNADSNSSSHLQLIYNLTICELNGTDWLNNHFG (Group D-5); Seq ID No: 837) |
| MJ-120 | LVNANNSSSSHTQLIYNLTLCELNGTFWLSHKFD (Group D-8); Seq ID No: 1870) |
| MJ-121 | LVNAANSSSSHFQSIYNLTLCELNGTDWLSKKFD (Group D-8); Seq ID No: 1871) |
| MJ-122 | LVNANNTSSSHFQLIYNLTLCELNGTDWLKYKFE (Group D-8); Seq ID No: 1872) |
| MJ-123 | LVDANSNSSSHFQLIYNLTICELNGTDWLYKHFD (Group D-8); Seq ID No: 1873) |
| MJ-124 | FADGNGNNSTY-QYIYNLTICELNGTNWLSGHFE (Group E-1); Seq ID No: 1874) |
| MJ-125 | FADGNGNNSTY-QYIYNLTICELNGTNWLSDHFE (Group E-1); Seq ID No: 1875) |
| MJ-126 | FADGNDNNSTY-QYIYNLTICELNGTNWLSAHFE (Group E-1); Seq ID No: 1876) |
| MJ-127 | FADGNGNNSTY-QYIYNLTICELNGTDWLSAHFE (Group E-2); Seq ID No: 1877) |
| MJ-128 | FADGNGNDSTY-QYIYDLTICFLNGTHWLSNHFV (Group E-8); Seq ID No: 1878) |
| MJ-129 | FADGNGNDSTY-QYIYNLTICELNGTSWLSDHFE (Group E-4); Seq ID No: 1879) |
| MJ-130 | FADGSGNNSTY-QYIYNLTICELNGTDWLSGHFN (Group E-2); Seq ID No: 1880) |
| MJ-131 | FADGSGNNSTY-QYIYNLTICELNGTKWLSGHFD (Group E-3); Seq ID No: 1881) |
| MJ-132 | FADGNGNSSTY-QYIYNLTICELNGTTWLSGHFN (Group E-4); Seq ID No: 1882) |
| MJ-133 | FADGNGNSSTY-QYIYNLTICELNGTNWLSGHFN (Group E-1); Seq ID No: 1883) |
| MJ-134 | FADGNGNNSTY-QYIYNLTICELNGTDWLSNHFS (Group E-6); Seq ID No: 1884) |
| MJ-135 | FADGNDNNSTY-QYIYNLTICELNGTNWLSNHFS (Group E-5); Seq ID No: 1885) |
| MJ-136 | FADGNGDSSTYQYIYNLTICELNGTDWLSSHFG (Group E-7); Seq ID No: 1886) |
| LV | FADGNGDSSTY-QYIYNLTICELNGTDWLSSHFG (Group E-7); Seq ID No: 1887) |
| | \|← HV1 →\|←C.Region→\|← HV2 →\| |

All references cited herein are hereby incorporated by reference in their entireties, whether previously specifically incorporated or not. As used herein, the terms "a", "an", and "any" are each intended to include both the singular and plural forms.

Having now fully described the invention, it will be appreciated by those skilled in the art that the same can be performed within a wide range of equivalent parameters, concentrations, and conditions without departing from the spirit and scope of the disclosure and without undue experimentation. While the invention has been described in connection with specific embodiments thereof, it will be understood that it is capable of further modifications. This application is intended to cover any variations, uses, or adaptations of the disclosure following, in general, the principles of the disclosure and including such departures from the present disclosure as come within known or customary practice within the art to which the disclosure pertains and as may be applied to the essential features hereinbefore set forth.

SEQUENCE LISTING (1887 sequences)

SEQ ID NO: 1 - protein, 6 aa, Porcine reproductive and respiratory syndrome virus
  MISC_FEATURE (2)..(2): X is E or S
  MISC_FEATURE (6)..(6): X is T or A
CXLNGX

SEQ ID NO: 2 - protein, 6 aa, Porcine reproductive and respiratory syndrome virus
CELNGT

SEQ ID NO: 3 - protein, 6 aa, Porcine reproductive and respiratory syndrome virus
CELNGA

SEQ ID NO: 4 - protein, 6 aa, Porcine reproductive and respiratory syndrome virus
CSLNGT

SEQ ID NO: 5 - protein, 6 aa, Porcine reproductive and respiratory syndrome virus
CSLNGA

SEQ ID NO: 6 - protein, 12 aa, Porcine reproductive and respiratory syndrome virus
  MISC_FEATURE (2)..(2): X is Y or F
  MISC_FEATURE (3)..(3): X is N or D or S or K
  MISC_FEATURE (4)..(4): X is L or S or F or M
  MISC_FEATURE (5)..(5): X is T or P or M
  MISC_FEATURE (6)..(6): X is L or I
  MISC_FEATURE (8)..(8): X is E or S
  MISC_FEATURE (12)..(12): X is T or A
IXXXXXCXLNGX

SEQ ID NO: 7 - protein, 10 aa, Porcine reproductive and respiratory syndrome virus
ANKFDWAVET

SEQ ID NO: 8 - protein, 10 aa, Porcine reproductive and respiratory syndrome virus
ANKFDWAVEP

SEQ ID NO: 9 - protein, 10 aa, Porcine reproductive and respiratory syndrome virus
AGEFDWAVET

SEQ ID NO: 10 - protein, 10 aa, Porcine reproductive and respiratory syndrome virus
ADKFDWAVEP

SEQ ID NO: 11 - protein, 10 aa, Porcine reproductive and respiratory syndrome virus
ADRFDWAVEP

SEQ ID NO: 12 - protein, 10 aa, Porcine reproductive and respiratory syndrome virus
SSHFGWAVET

SEQ ID NO: 13 - protein, 200 aa, Porcine reproductive and respiratory syndrome virus
MLEKCLTAGCCSRLLSLWCIVPFCFAVLANASNDSSSHLQLIYNLTLCELNGTDWLANKFDWAVESFVIFPVLTHIVSYGALTTSHFLDTVALVTVSTAGFVHGRYVLSSIYAVCALAALTCFVIRFAKNCMSWRYACTRYTNFLLDTKGRLYRWRSPVIIEKRGKVEVEGHLIDLKRVVLDGSVATPITRVSAEQWGRP

SEQ ID NO: 14 - protein, 201 aa, Porcine reproductive and respiratory syndrome virus
MRCSHKLGRFLTPHSCFWWLFLLCTGLSWSFADGNGDSSTYQYIYNLTICELNGTDWLSSHFGWAVETFVLYPVATHILSLGFLTTSHFFDALGLGAVSTAGFVGGRYVLCSVYGACAFAAFVCFVIRAAKNCMAYRYARTRFTNFIVDDRGRVHRWKSPIVVEKLGKAEVDGNLVTIKHVVLEGVKAQPLTRTSAEQWEA

SEQ ID NO: 15 - protein, 34 aa, Porcine reproductive and respiratory syndrome virus
SFADGNGDSSTYQYIYNLTICELNGTDWLSSHFG

SEQ ID NO: 16 - protein, 34 aa, Porcine reproductive and respiratory syndrome virus
SFVDGNDNSSTYQYIYNLTICELNGTEWLSSHFD

SEQ ID NO: 17 - protein, 34 aa, Porcine reproductive and respiratory syndrome virus
LANASNDSSSHVQLIYNLTLCELNGTDWLANKFD

SEQ ID NO: 18 - protein, 34 aa, Porcine reproductive and respiratory syndrome virus
LVNASSTSSSHLQLIYNLTICELNGTDWLNEKFD

SEQ ID NO: 19 - protein, 34 aa, Porcine reproductive and respiratory syndrome virus
LVNANTDSSSHLQLIYNLTICELNGTDWLNDKFD

SEQ ID NO: 20 - protein, 34 aa, Porcine reproductive and respiratory syndrome virus
LVNASNNSSSHLQLIYNLTICELNGTDWLNDKFD

SEQ ID NO: 21 - protein, 34 aa, Porcine reproductive and respiratory syndrome virus
LANASANSSSHLQLIYNLTLCELNGTDWLADKFD

SEQ ID NO: 22 - protein, 34 aa, Porcine reproductive and respiratory syndrome virus
SFVDGNDSSSTYQYIYNLTICELNGTEWLSSHFD

SEQ ID NO: 23 - protein, 34 aa, Porcine reproductive and respiratory syndrome virus
SFADGNGDSSTYQYIYNLTICELNGTAWLSSHFD

SEQ ID NO: 24 - protein, 34 aa, Porcine reproductive and respiratory syndrome virus
SFADGNGDSSTYQYIYNLTICELNGTDWLSSHFD

SEQ ID NO: 25 - protein, 34 aa, Porcine reproductive and respiratory syndrome virus
SFADGNGDSSTYQYIYNLTICELNGTEWLSSHFD

SEQ ID NO: 26 - protein, 34 aa, Porcine reproductive and respiratory syndrome virus
SFVDGDNNSSTYQYIYNLTICELNGTNWLSSHFD

SEQ ID NO: 27 - protein, 34 aa, Porcine reproductive and respiratory syndrome virus
SFADGNGSSSTYQYIYNLTICELNGTAWLSSYFD

SEQ ID NO: 28 - protein, 34 aa, Porcine reproductive and respiratory syndrome virus
SFADGSGNSSTYQYIYNLTICELNGTDWLSSHFG

SEQ ID NO: 29 - protein, 34 aa, Porcine reproductive and respiratory syndrome virus
SFADGNGDSSTYQYIYNLTICELNGTEWLSSHFG

SEQ ID NO: 30 - protein, 34 aa, Porcine reproductive and respiratory syndrome virus
SFADGNGNSSTYQYIYNLTICELNGTDWLSGEFH

SEQ ID NO: 31 - protein, 34 aa, Porcine reproductive and respiratory syndrome virus
SFADGNGNSSTYQYIYNLTICELNGTDWLSSHFG

SEQ ID NO: 32 - protein, 34 aa, Porcine reproductive and respiratory syndrome virus; identical to SEQ ID NO: 15

SEQ ID NO: 33 - protein, 34 aa, Porcine reproductive and respiratory syndrome virus; identical to SEQ ID NO: 15

SEQ ID NO: 34 - protein, 34 aa, Porcine reproductive and respiratory syndrome virus; identical to SEQ ID NO: 24

SEQ ID NO: 35 - protein, 34 aa, Porcine reproductive and respiratory syndrome virus; identical to SEQ ID NO: 24

SEQ ID NO: 36 - protein, 34 aa, Porcine reproductive and respiratory syndrome virus
LVNANSASSSHLQLIYNLTLCELNGTDWLADKFD

SEQ ID NO: 37 - protein, 34 aa, Porcine reproductive and respiratory syndrome virus
LGNANSTSSSHLQLIYNLTLCELNGTDWLANKFD

SEQ ID NO: 38 - protein, 34 aa, Porcine reproductive and respiratory syndrome virus
LVNANSTSSSHLQLIYNLTLCELNGTDWLANKFD

SEQ ID NO: 39 - protein, 34 aa, Porcine reproductive and respiratory syndrome virus
LVNANSNSSSHFQLIYNLTLCELNGTDWLANKFD

SEQ ID NO: 40 - protein, 34 aa, Porcine reproductive and respiratory syndrome virus; identical to SEQ ID NO: 39

SEQ ID NO: 41 - protein, 34 aa, Porcine reproductive and respiratory syndrome virus
LVNANSSSSSHFQLIYNLTLCELNGTDWLAEKFD

SEQ ID NO: 42 - protein, 34 aa, Porcine reproductive and respiratory syndrome virus
LVNANSSSSSHFQLIYNLTLCELNGTDWLAGKFD

SEQ ID NO: 43 - protein, 34 aa, Porcine reproductive and respiratory syndrome virus
LANAHGNSSSHLQLIYNLTLCELNGTDWLADRFD

SEQ ID NO: 44 - protein, 34 aa, Porcine reproductive and respiratory syndrome virus
LVNANSSSSSHFQLIYNLTLCELNGTDWLADKFD

SEQ ID NO: 45 - protein, 34 aa, Porcine reproductive and respiratory syndrome virus
LVSANSNSSSHLQLIYNLTLCELNGTDWLANKFD

SEQ ID NO: 46 - protein, 34 aa, Porcine reproductive and respiratory syndrome virus
LVSANSNSSSHLQLIYNLTLCELNGTDWLASRFD

SEQ ID NO: 47 - protein, 34 aa, Porcine reproductive and respiratory syndrome virus
LANASNDSSSHLQLIYNLTLCELNGTDWLANKFD

SEQ ID NO: 48 - protein, 34 aa, Porcine reproductive and respiratory syndrome virus
LVNASYSSSSHLQLIYNLTLCELNGTDWLANKFD

SEQ ID NO: 49 - protein, 34 aa, Porcine reproductive and respiratory syndrome virus
LVNANSNSSSHLQLIYNLTLCELNGTDWLSNKFD

SEQ ID NO: 50 - protein, 34 aa, Porcine reproductive and respiratory syndrome virus; identical to SEQ ID NO: 47

SEQ ID NO: 51 - protein, 34 aa, Porcine reproductive and respiratory syndrome virus; identical to SEQ ID NO: 47

SEQ ID NO: 52 - protein, 34 aa, Porcine reproductive and respiratory syndrome virus
LANASNNSSSHLQLIYNLTLCELNGKDWLANKFD

SEQ ID NO: 53 - protein, 34 aa, Porcine reproductive and respiratory syndrome virus; identical to SEQ ID NO: 47

SEQ ID NO: 54 - protein, 34 aa, Porcine reproductive and respiratory syndrome virus; identical to SEQ ID NO: 47

SEQ ID NO: 55 - protein, 34 aa, Porcine reproductive and respiratory syndrome virus
LANASNNSSSHLQLIYNLTLCELNGTDWLANKFD

SEQ ID NO: 56 - protein, 34 aa, Porcine reproductive and respiratory syndrome virus; identical to SEQ ID NO: 47

SEQ ID NO: 57 - protein, 34 aa, Porcine reproductive and respiratory syndrome virus; identical to SEQ ID NO: 47

SEQ ID NO: 58 - protein, 34 aa, Porcine reproductive and respiratory syndrome virus
LVNASNDSSSHLQLIYNLTLCELNGTDWLANKFD

SEQ ID NO: 59 - protein, 34 aa, Porcine reproductive and respiratory syndrome virus
LVSANANSSSKLQLIYNLTLCELNGTDWLANKFD

SEQ ID NO: 60 - protein, 34 aa, Porcine reproductive and respiratory syndrome virus
LANASANNSSHLQLIYNLTLCELNGTDWLANKFD

SEQ ID NO: 61 - protein, 34 aa, Porcine reproductive and respiratory syndrome virus
LANASANSSSHLQLIYNLTLCELNGTDWLANKFD

SEQ ID NO: 62 - protein, 34 aa, Porcine reproductive and respiratory syndrome virus
IVNASNNSSSHLQLIYNLTLCELNGTDWLADKFD

SEQ ID NO: 63 - protein, 34 aa, Porcine reproductive and respiratory syndrome virus
LVNANNNSSSHLQLIYNLTLCELNGTDWLANRFD

SEQ ID NO: 64 - protein, 34 aa, Porcine reproductive and respiratory syndrome virus
LVNASNNSSSHLQLIYNLTLCELNGTDWLANKFD

SEQ ID NO: 65 - protein, 34 aa, Porcine reproductive and respiratory syndrome virus
LVDASGNSSSHLQLIYNLTLCELNGTDWLANKFS

SEQ ID NO: 66 - protein, 34 aa, Porcine reproductive and respiratory syndrome virus
LVNASNNSSSHFQLIYNLTLCELNGTDWLAGKFD

SEQ ID NO: 67 - protein, 34 aa, Porcine reproductive and respiratory syndrome virus
IVNANSSSSSHFQLIYNLTLCELNGTDWLKNKFD

SEQ ID NO: 68 - protein, 34 aa, Porcine reproductive and respiratory syndrome virus
LVNANSNSSSHLQLIYNLTLCELNGTDWLKDRFD

SEQ ID NO: 69 - protein, 34 aa, Porcine reproductive and respiratory syndrome virus
IVNANSNSSSHFQLIYNLTLCELNGTDWLAEKFD

SEQ ID NO: 70 - protein, 34 aa, Porcine reproductive and respiratory syndrome virus; identical to SEQ ID NO: 67

SEQ ID NO: 71 - protein, 34 aa, Porcine reproductive and respiratory syndrome virus
LPNANENSSSHLQLIYNLTLCELNGTDWLADKFD

SEQ ID NO: 72 - protein, 34 aa, Porcine reproductive and respiratory syndrome virus; identical to SEQ ID NO: 47

SEQ ID NO: 73 - protein, 34 aa, Porcine reproductive and respiratory syndrome virus
LVSANSNSSSHLQLIYNLTLCELNGTDWLASKFD

SEQ ID NO: 74 - protein, 34 aa, Porcine reproductive and respiratory syndrome virus; identical to SEQ ID NO: 47

SEQ ID NO: 75 - protein, 34 aa, Porcine reproductive and respiratory syndrome virus
LANASNGSSSHLQLIYNLTLCELNGTDWLANKFD

SEQ ID NO: 76 - protein, 34 aa, Porcine reproductive and respiratory syndrome virus
LANANNNSSSQLQLIYNLTLCELNGTDWLANKFD

SEQ ID NO: 77 - protein, 34 aa, Porcine reproductive and respiratory syndrome virus; identical to SEQ ID NO: 49

SEQ ID NO: 78 - protein, 34 aa, Porcine reproductive and respiratory syndrome virus
IVNANSNSSSHFQLIYNLTVCELNGTDWLTGKFD

SEQ ID NO: 79 - protein, 34 aa, Porcine reproductive and respiratory syndrome virus; identical to SEQ ID NO: 55

SEQ ID NO: 80 - protein, 34 aa, Porcine reproductive and respiratory syndrome virus; identical to SEQ ID NO: 55

SEQ ID NO: 81 - protein, 34 aa, Porcine reproductive and respiratory syndrome virus
LVNADSNSSSHFQLIYNLTLCELNGTEWLANNFD

SEQ ID NO: 82 - protein, 34 aa, Porcine reproductive and respiratory syndrome virus; identical to SEQ ID NO: 55

SEQ ID NO: 83 - protein, 34 aa, Porcine reproductive and respiratory syndrome virus
LANANNASSSHLQLIYNLTLCELNGTDWLANKFD

SEQ ID NO: 84 - protein, 34 aa, Porcine reproductive and respiratory syndrome virus; identical to SEQ ID NO: 48

SEQ ID NO: 85 - protein, 34 aa, Porcine reproductive and respiratory syndrome virus
SFADGNGNSSTYQYIYNLTICELNGTVWLSTNFY

SEQ ID NO: 86 - protein, 34 aa, Porcine reproductive and respiratory syndrome virus; identical to SEQ ID NO: 15

SEQ ID NO: 87 - protein, 34 aa, Porcine reproductive and respiratory syndrome virus; identical to SEQ ID NO: 15

SEQ ID NO: 88 - protein, 34 aa, Porcine reproductive and respiratory syndrome virus; identical to SEQ ID NO: 15

SEQ ID NO: 89 - protein, 34 aa, Porcine reproductive and respiratory syndrome virus
SFADGNGNSSTYQYIYNLTICELNGTDWLSTKFY

SEQ ID NO: 90 - protein, 34 aa, Porcine reproductive and respiratory syndrome virus; identical to SEQ ID NO: 47

SEQ ID NO: 91 - protein, 34 aa, Porcine reproductive and respiratory syndrome virus
IVNASSNSSSHFQLIYNLTLCELNGTYWLANKFD

SEQ ID NO: 92 - protein, 34 aa, Porcine reproductive and respiratory syndrome virus
LVNANSNSSSHFQLIYNLTLCELNGTDWLNEHFG

SEQ ID NO: 93 - protein, 34 aa, Porcine reproductive and respiratory syndrome virus
LVNANSNSSSHFQLIYNLTLCELNGTDWLAEKFD

SEQ ID NO: 94 - protein, 34 aa, Porcine reproductive and respiratory syndrome virus; identical to SEQ ID NO: 39

SEQ ID NO: 95 - protein, 34 aa, Porcine reproductive and respiratory syndrome virus; identical to SEQ ID NO: 24

SEQ ID NO: 96 - protein, 34 aa, Porcine reproductive and respiratory syndrome virus
SFADGNGNSSTYQYIYNLTICELNGTAWLSDKFY

SEQ ID NO: 97 - protein, 34 aa, Porcine reproductive and respiratory syndrome virus
SFADGNGNSSTYQYIYNLTICELNGTAWLSSNFY

SEQ ID NO: 98 - protein, 34 aa, Porcine reproductive and respiratory syndrome virus
SFADGNGNSSTYLYIYNLTICELNGTDWLSNKYY

SEQ ID NO: 99 - protein, 34 aa, Porcine reproductive and respiratory syndrome virus
SFADGNGDSSTYQYIYNLTICELNGTAWLSSNFY

SEQ ID NO: 100 - protein, 34 aa, Porcine reproductive and respiratory syndrome virus
SFADGNGDSSTYQYIYNLTICELNGTDWLSNNFY

SEQ ID NO: 101 - protein, 34 aa, Porcine reproductive and respiratory syndrome virus
SFADGNGNSSTYQYIYNLTICELNGTNWLSNKFY

SEQ ID NO: 102 - protein, 34 aa, Porcine reproductive and respiratory syndrome virus; identical to SEQ ID NO: 97

SEQ ID NO: 103 - protein, 33 aa, Porcine reproductive and respiratory syndrome virus
FADGSGNSSTYQYIYNLTICELNGTAWLSSHFD

SEQ ID NO: 104 - protein, 34 aa, Porcine reproductive and respiratory syndrome virus
SFADGNGNSSTYQYIYNLTICELNGTDWLSDRFY

SEQ ID NO: 105 - protein, 34 aa, Porcine reproductive and respiratory syndrome virus
SFADGNGNSSTYQYIYNLTICELNGTDWLSNRFY

SEQ ID NO: 106 - protein, 34 aa, Porcine reproductive and respiratory syndrome virus
SFADGNGNSSTYQYIYNLTICELNGTDWLSNKFY

SEQ ID NO: 107 - protein, 34 aa, Porcine reproductive and respiratory syndrome virus
SFADGNGNSSTYQYIYNLTICELNGTDWLSNNFY

SEQ ID NO: 108 - protein, 34 aa, Porcine reproductive and respiratory syndrome virus
SFADGNGDSSTYQYIYNLTICELNGTDWLSDHFY

SEQ ID NO: 109 - protein, 34 aa, Porcine reproductive and respiratory syndrome virus
SFADGNGNSSTYQYIYNLTICELNGTDWLSDHFY

SEQ ID NO: 110 - protein, 34 aa, Porcine reproductive and respiratory syndrome virus; identical to SEQ ID NO: 99

SEQ ID NO: 111 - protein, 34 aa, Porcine reproductive and respiratory syndrome virus
SFADGSGNSSTYQYIYNLTICELNGTDWLSSHFS

SEQ ID NO: 112 - protein, 34 aa, Porcine reproductive and respiratory syndrome virus; identical to SEQ ID NO: 31

SEQ ID NO: 113 - protein, 34 aa, Porcine reproductive and respiratory syndrome virus; identical to SEQ ID NO: 31

SEQ ID NO: 114 - protein, 34 aa, Porcine reproductive and respiratory syndrome virus
SFADGNGNSSTYQYIYNLTICELNGTNWLSSHFG

SEQ ID NO: 115 - protein, 34 aa, Porcine reproductive and respiratory syndrome virus
SFADGNGNSLTYQYIYNLTICELNGTDWLSSHFG

SEQ ID NO: 116 - protein, 34 aa, Porcine reproductive and respiratory syndrome virus; identical to SEQ ID NO: 115

SEQ ID NO: 117 - protein, 34 aa, Porcine reproductive and respiratory syndrome virus; identical to SEQ ID NO: 15

SEQ ID NO: 118 - protein, 34 aa, Porcine reproductive and respiratory syndrome virus; identical to SEQ ID NO: 15

SEQ ID NO: 119 - protein, 34 aa, Porcine reproductive and respiratory syndrome virus
SFADGSGDSSTYQYIYNLTICELNGTAWLSSHFD

SEQ ID NO: 120 - protein, 34 aa, Porcine reproductive and respiratory syndrome virus
SFADGNGNSSTYQYIYNLTICELNGTYWLSSHFS

SEQ ID NO: 121 - protein, 34 aa, Porcine reproductive and respiratory syndrome virus
SFADGNGNSSTYQYIYNLTICELNGTDWLSDKFD

SEQ ID NO: 122 - protein, 34 aa, Porcine reproductive and respiratory syndrome virus
SFADGNGNSSTYQYIYNLTICELNGTAWLSDHFQ

SEQ ID NO: 123 - protein, 34 aa, Porcine reproductive and respiratory syndrome virus
SFAEGNGNSSTYQYIYNLTICELNGTDWLSAHFE

SEQ ID NO: 124 - protein, 34 aa, Porcine reproductive and respiratory syndrome virus
SFADGNGNSSTYQYIYNLTICELNGTHWLSNHFD

SEQ ID NO: 125 - protein, 34 aa, Porcine reproductive and respiratory syndrome virus
SFAECNGNSSTYRSIYNLTICELNGTQWLSDKFD

SEQ ID NO: 126 - protein, 34 aa, Porcine reproductive and respiratory syndrome virus
SFADGNGNSSTYQYIYNLTICELNGTEWLSNKFY

SEQ ID NO: 127 - protein, 34 aa, Porcine reproductive and respiratory syndrome virus
SFADGGGNSSTYQYIYNLTICELNGTAWLSNHFH

SEQ ID NO: 128 - protein, 34 aa, Porcine reproductive and respiratory syndrome virus
SFVAGSGNSSTYQYIYNLTICELNGTDWLSNHFD

SEQ ID NO: 129 - protein, 34 aa, Porcine reproductive and respiratory syndrome virus
SFADGSGNSSTYQYIYNLTICELNGTAWLSSHFD

SEQ ID NO: 130 - protein, 34 aa, Porcine reproductive and respiratory syndrome virus
SFADGNGSSSTYQYIYNLTICELNGTDWLSSHFG

SEQ ID NO: 131 - protein, 34 aa, Porcine reproductive and respiratory syndrome virus; identical to SEQ ID NO: 31

SEQ ID NO: 132 - protein, 34 aa, Porcine reproductive and respiratory syndrome virus; identical to SEQ ID NO: 31

SEQ ID NO: 133 - protein, 34 aa, Porcine reproductive and respiratory syndrome virus
SFADGNGNSSTYQYIYNLTICELNGTAWLSDHFD

SEQ ID NO: 134 - protein, 34 aa, Porcine reproductive and respiratory syndrome virus
SFADGNGNSSTYQYIYDLTICELNGTQWLSDNFY

SEQ ID NO: 135 - protein, 34 aa, Porcine reproductive and respiratory syndrome virus
SFADGNGNSSTYQYIYNLTICELNGTTWLHDRFD

SEQ ID NO: 136 - protein, 34 aa, Porcine reproductive and respiratory syndrome virus; identical to SEQ ID NO: 100

SEQ ID NO: 137 - protein, 34 aa, Porcine reproductive and respiratory syndrome virus; identical to SEQ ID NO: 15

SEQ ID NO: 138 - protein, 34 aa, Porcine reproductive and respiratory syndrome virus; identical to SEQ ID NO: 15

SEQ ID NO: 139 - protein, 34 aa, Porcine reproductive and respiratory syndrome virus; identical to SEQ ID NO: 15

SEQ ID NO: 140 - protein, 34 aa, Porcine reproductive and respiratory syndrome virus
SFADGNGNSSTYQYIYNLTICELNGTAWLANHFE

SEQ ID NO: 141 - protein, 33 aa, Porcine reproductive and respiratory syndrome virus
FADGNGNSSTYQYIYNLTICELNGTGWLANHFE

SEQ ID NO: 142 - protein, 34 aa, Porcine reproductive and respiratory syndrome virus
SFADCNDNSSTYQYIYNLTICELNGTKWLSSHFD

SEQ ID NO: 143 - protein, 34 aa, Porcine reproductive and respiratory syndrome virus
SFVDGNDSSSTYQYIYNLTICELNGTEWLPSHFD

SEQ ID NO: 144 - protein, 34 aa, Porcine reproductive and respiratory syndrome virus
SFADGNGNSSTYQYIYKLTICELNGTEWLSTHFD

SEQ ID NO: 145 - protein, 34 aa, Porcine reproductive and respiratory syndrome virus
SFADGNGNSSTHQYIYNLTICELNGTNWLSNHFG

SEQ ID NO: 146 - protein, 34 aa, Porcine reproductive and respiratory syndrome virus
SFVAGNDNSSTYQYIYNLTICELNGTEWLSGHFA

SEQ ID NO: 147 - protein, 34 aa, Porcine reproductive and respiratory syndrome virus
SFVDGNGNSSTYQYIYNLTICELNGTKWLSSHFY

SEQ ID NO: 148 - protein, 34 aa, Porcine reproductive and respiratory syndrome virus
SFVDGNVSSSTYQYIYDLTICELNGTEWLHSHFD

SEQ ID NO: 149 - protein, 34 aa, Porcine reproductive and respiratory syndrome virus
SFVAGSDNSSTYQYIYNLTICELNGTDWLSNHFD

SEQ ID NO: 150 - protein, 34 aa, Porcine reproductive and respiratory syndrome virus; identical to SEQ ID NO: 146

SEQ ID NO: 151 - protein, 34 aa, Porcine reproductive and respiratory syndrome virus
SFADGNDNSSTYQYIYDLTICELNGTYWLSNHFS

SEQ ID NO: 152 - protein, 34 aa, Porcine reproductive and respiratory syndrome virus
SSVDGNGNSSTYQYIYNLTICELNGTDWLSASFS

SEQ ID NO: 153 - protein, 34 aa, Porcine reproductive and respiratory syndrome virus
SFVAVSGNSSTYQYIYNLTICELNGTNWLSDHFD

SEQ ID NO: 154 - protein, 34 aa, Porcine reproductive and respiratory syndrome virus
SFVAVSGNSSTYQYIYNLTICELNGTNWLPDHFD

SEQ ID NO: 155 - protein, 34 aa, Porcine reproductive and respiratory syndrome virus; identical to SEQ ID NO: 133

SEQ ID NO: 156 - protein, 34 aa, Porcine reproductive and respiratory syndrome virus
SSADGNGNSSTYQYIYNLTICELNGTGWLTAHFE

SEQ ID NO: 157 - protein, 34 aa, Porcine reproductive and respiratory syndrome virus; identical to SEQ ID NO: 47

SEQ ID NO: 158 - protein, 31 aa, Porcine reproductive and respiratory syndrome virus
DGNGNSSTYQYIYNLTICELNGTDWLSSHFG

SEQ ID NO: 159 - protein, 31 aa, Porcine reproductive and respiratory syndrome virus
DGNGNSSTYQYIYNLTICELNGTKWLSSHFD

SEQ ID NO: 160 - protein, 30 aa, Porcine reproductive and respiratory syndrome virus
ASGNSSTYQYIYNLTICELNGTEWLSGHFD

SEQ ID NO: 161 - protein, 30 aa, Porcine reproductive and respiratory syndrome virus
ASGNSSTLQYIYNLTICELNGTDWLANKFD

SEQ ID NO: 162 - protein, 31 aa, Porcine reproductive and respiratory syndrome virus
DGNDNSSTYQYIYNLTICELNGTKWLSSHFD

SEQ ID NO: 163 - protein, 31 aa, Porcine reproductive and respiratory syndrome virus
DGNGNSSTYQYIYNLTICELNGTEWLSSHFS

SEQ ID NO: 164 - protein, 31 aa, Porcine reproductive and respiratory syndrome virus
DGNGNSSTYQYIYNLTICELNGTEWLSSHFD

SEQ ID NO: 165 - protein, 31 aa, Porcine reproductive and respiratory syndrome virus
DGNGNSSTYQYIYNLTICELNGTKWLSGHFD

SEQ ID NO: 166 - protein, 31 aa, Porcine reproductive and respiratory syndrome virus
DGSGNSSTYLYIYNLTICELNGTQWLSDHFS

SEQ ID NO: 167 - protein, 31 aa, Porcine reproductive and respiratory syndrome virus
DGNDNSSTYQYIYNLTICELNGTEWLSSHFD

SEQ ID NO: 168 - protein, 30 aa, Porcine reproductive and respiratory syndrome virus
GSGNSSTYQYIYNLTICELNGTDWLSNHFD

SEQ ID NO: 169 - protein, 31 aa, Porcine reproductive and respiratory syndrome virus
DGNGNSSTYQYIYNLTICELNGTDWLSNHFS

SEQ ID NO: 170 - protein, 31 aa, Porcine reproductive and respiratory syndrome virus
DGSDNSSTYQYIYNLMICELNGTQWLSNHFS

SEQ ID NO: 171 - protein, 31 aa, Porcine reproductive and respiratory syndrome virus; identical to SEQ ID NO: 158

SEQ ID NO: 172 - protein, 34 aa, Porcine reproductive and respiratory syndrome virus
LANASDNSSSHLQLIYNLTLCELNGTDWLANKFD

SEQ ID NO: 173 - protein, 34 aa, Porcine reproductive and respiratory syndrome virus; identical to SEQ ID NO: 55

SEQ ID NO: 174 - protein, 34 aa, Porcine reproductive and respiratory syndrome virus; identical to SEQ ID NO: 47

SEQ ID NO: 175 - protein, 34 aa, Porcine reproductive and respiratory syndrome virus; identical to SEQ ID NO: 47

SEQ ID NO: 176 - protein, 34 aa, Porcine reproductive and respiratory syndrome virus; identical to SEQ ID NO: 47

SEQ ID NO: 177 - protein, 34 aa, Porcine reproductive and respiratory syndrome virus
LANADSNSSSHLQLIYNLTLCELNGTDWLANKFD

SEQ ID NO: 178 - protein, 34 aa, Porcine reproductive and respiratory syndrome virus
LANASNNSSSHLQLIYNLTLCELNGTDWLASKFD

SEQ ID NO: 179 - protein, 34 aa, Porcine reproductive and respiratory syndrome virus; identical to SEQ ID NO: 177

SEQ ID NO: 180 - protein, 34 aa, Porcine reproductive and respiratory syndrome virus; identical to SEQ ID NO: 49

SEQ ID NO: 181 - protein, 34 aa, Porcine reproductive and respiratory syndrome virus
LVNASNGSSSHLQLIYNLTLCELNGTDWLANRFD

SEQ ID NO: 182 - protein, 34 aa, Porcine reproductive and respiratory syndrome virus
LANASANSSSHIQLIYNLTLCELNGTDWLANKFD

SEQ ID NO: 183 - protein, 34 aa, Porcine reproductive and respiratory syndrome virus
LVNANGNSSSHLQLIYNLTLCELNGTDWLANKFD

SEQ ID NO: 184 - protein, 34 aa, Porcine reproductive and respiratory syndrome virus
LVSADRNSSSNLQLIYNLTLCELNGTDWLANKFD

SEQ ID NO: 185 - protein, 34 aa, Porcine reproductive and respiratory syndrome virus; identical to SEQ ID NO: 46

SEQ ID NO: 186 - protein, 34 aa, Porcine reproductive and respiratory syndrome virus; identical to SEQ ID NO: 46

SEQ ID NO: 187 - protein, 34 aa, Porcine reproductive and respiratory syndrome virus
LVNANGNSSSHLQLIYNLTLCELNGTDWLADKFD

SEQ ID NO: 188 - protein, 34 aa, Porcine reproductive and respiratory syndrome virus
LVNANSNSSSHLQLIYNLTLCELNGTDWLKDKFD

SEQ ID NO: 189 - protein, 34 aa, Porcine reproductive and respiratory syndrome virus; identical to SEQ ID NO: 188

SEQ ID NO: 190 - protein, 34 aa, Porcine reproductive and respiratory syndrome virus
SFADGNGNSSTYQYIYDLTICELNGTAWLSGNFH

SEQ ID NO: 191 - protein, 34 aa, Porcine reproductive and respiratory syndrome virus
SFAECNGNSSTHQYIYNLTVCELNGTAWLSSHFD

SEQ ID NO: 192 - protein, 34 aa, Porcine reproductive and respiratory syndrome virus; identical to SEQ ID NO: 105

SEQ ID NO: 193 - protein, 34 aa, Porcine reproductive and respiratory syndrome virus
SFADGNGNSSTYQYIYNLTICELNGTEWLSDKFY

SEQ ID NO: 194 - protein, 34 aa, Porcine reproductive and respiratory syndrome virus; identical to SEQ ID NO: 105

SEQ ID NO: 195 - protein, 34 aa, Porcine reproductive and respiratory syndrome virus
SFADGNGNSSTYQYIYDLTICELNGTDWLSGHFD

SEQ ID NO: 196 - protein, 34 aa, Porcine reproductive and respiratory syndrome virus
SFADGNGNNSTYQYIYNLTICELNGTSWLHGHFD

SEQ ID NO: 197 - protein, 33 aa, Porcine reproductive and respiratory syndrome virus
FADGNGNSSTYQYIYNLTICELNGTEWLSNKFD

SEQ ID NO: 198 - protein, 34 aa, Porcine reproductive and respiratory syndrome virus
SFAECNGNSSTHQYIYNLTICELNGTNWLSNHFD

SEQ ID NO: 199 - protein, 34 aa, Porcine reproductive and respiratory syndrome virus
SFAECNGDSSTSQYIYNLTICELNGTAWLSEHFD

SEQ ID NO: 200 - protein, 34 aa, Porcine reproductive and respiratory syndrome virus
SFADGNGNSSTYQYIYNLTICELNGTDWLSDRFD

SEQ ID NO: 201 - protein, 34 aa, Porcine reproductive and respiratory syndrome virus
SFADGNGNSSTYQYIYNLTICELNGTTWLSKEFD

SEQ ID NO: 202 - protein, 34 aa, Porcine reproductive and respiratory syndrome virus; identical to SEQ ID NO: 126

SEQ ID NO: 203 - protein, 34 aa, Porcine reproductive and respiratory syndrome virus; identical to SEQ ID NO: 126

SEQ ID NO: 204 - protein, 34 aa, Porcine reproductive and respiratory syndrome virus
SFAECTGNSSTYQYIYNLTICELNGTNWLTGHFG

SEQ ID NO: 205 - protein, 34 aa, Porcine reproductive and respiratory syndrome virus
SFADGNGNSSTYQYIYNLTICELNGTAWLSEHFQ

SEQ ID NO: 206 - protein, 34 aa, Porcine reproductive and respiratory syndrome virus; identical to SEQ ID NO: 200

SEQ ID NO: 207 - protein, 34 aa, Porcine reproductive and respiratory syndrome virus
SFAECNGNSSTYQYIYNLTICELNGTDWLSDKFY

SEQ ID NO: 208 - protein, 34 aa, Porcine reproductive and respiratory syndrome virus
SFADGSGNSSTYQYIYDLTICELNGTNWLSGHFD

SEQ ID NO: 209 - protein, 34 aa, Porcine reproductive and respiratory syndrome virus
SFADGNGNSSTYQYIYNLTICELNGTNWLSDKFY

SEQ ID NO: 210 - protein, 34 aa, Porcine reproductive and respiratory syndrome virus
SFADGNGNSSAYQYIYNLTICELNGTDWLSDKFY

SEQ ID NO: 211 - protein, 34 aa, Porcine reproductive and respiratory syndrome virus
SFADGNGNSSTYQYIYNLTICELNGTDWLSDKFY

SEQ ID NO: 212 - protein, 34 aa, Porcine reproductive and respiratory syndrome virus
SFADGNDNSSTYQYIYNLTICELNGTHWLHQHFS

SEQ ID NO: 213 - protein, 34 aa, Porcine reproductive and respiratory syndrome virus
SFADGNGNSSTYQYIYNLTICELNGTAWLSDHFY

SEQ ID NO: 214 - protein, 34 aa, Porcine reproductive and respiratory syndrome virus
SFADGNGNSSTYQYIYNLTICELNGTTWLSNHFY

SEQ ID NO: 215 - protein, 34 aa, Porcine reproductive and respiratory syndrome virus
SFADGSGNSSTYQYIYNLTICELNGTTWLSNHFD

SEQ ID NO: 216 - protein, 34 aa, Porcine reproductive and respiratory syndrome virus
SFADGNGNSSTYQYIYNLTICELNGTAWLHDHFY

SEQ ID NO: 217 - protein, 34 aa, Porcine reproductive and respiratory syndrome virus; identical to SEQ ID NO: 133

SEQ ID NO: 218 - protein, 34 aa, Porcine reproductive and respiratory syndrome virus
SFAGGNGNSSTYQYIYNLTICELNGTAWLSDHFY

SEQ ID NO: 219 - protein, 34 aa, Porcine reproductive and respiratory syndrome virus
SFADGNGNSSTYQYIYNLTICELNGTEWLSSHFH

SEQ ID NO: 220 - protein, 34 aa, Porcine reproductive and respiratory syndrome virus; identical to SEQ ID NO: 31

SEQ ID NO: 221 - protein, 34 aa, Porcine reproductive and respiratory syndrome virus; identical to SEQ ID NO: 15

SEQ ID NO: 222 - protein, 34 aa, Porcine reproductive and respiratory syndrome virus; identical to SEQ ID NO: 213

SEQ ID NO: 223 - protein, 34 aa, Porcine reproductive and respiratory syndrome virus
LVNANSNSSSHLQLIYNLTLCELNGTDWLANRFD

SEQ ID NO: 224 - protein, 34 aa, Porcine reproductive and respiratory syndrome virus; identical to SEQ ID NO: 223

SEQ ID NO: 225 - protein, 34 aa, Porcine reproductive and respiratory syndrome virus; identical to SEQ ID NO: 223

SEQ ID NO: 226 - protein, 34 aa, Porcine reproductive and respiratory syndrome virus
LVNANSNSSSHLQLIYNLTLCELNGTDWLADRFD

SEQ ID NO: 227 - protein, 34 aa, Porcine reproductive and respiratory syndrome virus
LVNANSNSSSHFQSIYNLTLCELNGTDWLADKFD

SEQ ID NO: 228 - protein, 34 aa, Porcine reproductive and respiratory syndrome virus
LVNANSNNSSHFQSIYNLTLCELNGTDWLANKFD

SEQ ID NO: 229 - protein, 34 aa, Porcine reproductive and respiratory syndrome virus
LVNASSNSSSHFQLIYNLTLCELNGTDWLANKFD

SEQ ID NO: 230 - protein, 34 aa, Porcine reproductive and respiratory syndrome virus
LVNASSTSSSHFQLIYNLTLCELNGTDWLANKFD

SEQ ID NO: 231 - protein, 34 aa, Porcine reproductive and respiratory syndrome virus; identical to SEQ ID NO: 230

SEQ ID NO: 232 - protein, 34 aa, Porcine reproductive and respiratory syndrome virus; identical to SEQ ID NO: 188

SEQ ID NO: 233 - protein, 34 aa, Porcine reproductive and respiratory syndrome virus; identical to SEQ ID NO: 188

SEQ ID NO: 234 - protein, 34 aa, Porcine reproductive and respiratory syndrome virus; identical to SEQ ID NO: 188

SEQ ID NO: 235 - protein, 34 aa, Porcine reproductive and respiratory syndrome virus
SFADGNGNNSTYQYIYNLTICELNGTNWLSGHFD

SEQ ID NO: 236 - protein, 34 aa, Porcine reproductive and respiratory syndrome virus
LANANNDSSSHLQLIYNLTLCELNGTDWLANKFD

SEQ ID NO: 237 - protein, 34 aa, Porcine reproductive and respiratory syndrome virus
SFADGSGNSSTYQYIYNLTICELNGTDWLSNHFS

SEQ ID NO: 238 - protein, 34 aa, Porcine reproductive and respiratory syndrome virus
SFADGNGNNSTYQYIYNLTICELNGTNWLSGHFE

SEQ ID NO: 239 - protein, 34 aa, Porcine reproductive and respiratory syndrome virus
SFVDGNGINSTYQYIYNLTICELNGTNWLSDHFE

SEQ ID NO: 240 - protein, 34 aa, Porcine reproductive and respiratory syndrome virus
SFVDGNGINSTYQYIYDLTICELNGTNWLSDHFE

SEQ ID NO: 241 - protein, 34 aa, Porcine reproductive and respiratory syndrome virus
SFADGNGNNSIYQYIYNLTVCELNGTNWLSDHFE

SEQ ID NO: 242 - protein, 33 aa, Porcine reproductive and respiratory syndrome virus
FADGNGINSTYQYIYNLTICELNGTNWLSNHFE

SEQ ID NO: 243 - protein, 34 aa, Porcine reproductive and respiratory syndrome virus
SFADGNGNNSTYQYIYNLTICELNGTDWLSGHFD

SEQ ID NO: 244 - protein, 33 aa, Porcine reproductive and respiratory syndrome virus
FADGNNINSTYQYIYNLTICELNGTNWLSDHFE

SEQ ID NO: 245 - protein, 34 aa, Porcine reproductive and respiratory syndrome virus
SFADGNGNNSTYQYIYNLTICELNGTNWLSAHFE

SEQ ID NO: 246 - protein, 33 aa, Porcine reproductive and respiratory syndrome virus
FADGNGINSTYQYIYNLTICELNGTNWLSDHFE

SEQ ID NO: 247 - protein, 34 aa, Porcine reproductive and respiratory syndrome virus; identical to SEQ ID NO: 245

SEQ ID NO: 248 - protein, 34 aa, Porcine reproductive and respiratory syndrome virus
SFADGNGNNSTYQYIYNLTICELNGTYWLSAHFE

SEQ ID NO: 249 - protein, 34 aa, Porcine reproductive and respiratory syndrome virus
SSADGNGNSSTYQYIYNLTICELNGTGWLSAHFE

SEQ ID NO: 250 - protein, 34 aa, Porcine reproductive and respiratory syndrome virus
SFADGNGNNSTYQYIYNLTICELNGTNWLSDHFE

SEQ ID NO: 251 - protein, 34 aa, Porcine reproductive and respiratory syndrome virus
SFADGNGNNSTYQYIYNLTICELNGTAWLSGHFD

SEQ ID NO: 252 - protein, 34 aa, Porcine reproductive and respiratory syndrome virus
SSADGNGNSSTYQYIYNSTICELNGTGWLSDHFE

SEQ ID NO: 253 - protein, 34 aa, Porcine reproductive and respiratory syndrome virus
LANASDDSSSHLQLIYNLTLCELNGTDWLANKFD

SEQ ID NO: 254 - protein, 34 aa, Porcine reproductive and respiratory syndrome virus
LVNANGNSSSNLQLIYNLTLCELNGTDWLANKFD

SEQ ID NO: 255 - protein, 34 aa, Porcine reproductive and respiratory syndrome virus
IVNATSNSSSHFQLIYNLTLCELNGTDWLVNKFD

SEQ ID NO: 256 - protein, 34 aa, Porcine reproductive and respiratory syndrome virus
LANASSDSSSHLQLIYNLTLCELNGTDWLANKFD

SEQ ID NO: 257 - protein, 34 aa, Porcine reproductive and respiratory syndrome virus; identical to SEQ ID NO: 31

SEQ ID NO: 258 - protein, 34 aa, Porcine reproductive and respiratory syndrome virus
SFADGNGNSSTYQYIYNLTICELNGTRWLSSHFD

SEQ ID NO: 259 - protein, 34 aa, Porcine reproductive and respiratory syndrome virus
SFADGNGNSSTYQYIYDLTICELNGTRWLSSHFD

SEQ ID NO: 260 - protein, 34 aa, Porcine reproductive and respiratory syndrome virus
SFVDGNDNSSTYQYIYNLTICELNGTAWLSSHFD

SEQ ID NO: 261 - protein, 34 aa, Porcine reproductive and respiratory syndrome virus
SSVDGNGSSSTRQYIYNLTICELNGTEWLSGHFD

SEQ ID NO: 262 - protein, 34 aa, Porcine reproductive and respiratory syndrome virus
SFADGNGNSSTYQYIYNLTICELNGTDWLTNHFD

SEQ ID NO: 263 - protein, 34 aa, Porcine reproductive and respiratory syndrome virus; identical to SEQ ID NO: 262

SEQ ID NO: 264 - protein, 34 aa, Porcine reproductive and respiratory syndrome virus; identical to SEQ ID NO: 15

SEQ ID NO: 265 - protein, 34 aa, Porcine reproductive and respiratory syndrome virus; identical to SEQ ID NO: 47

SEQ ID NO: 266 - protein, 34 aa, Porcine reproductive and respiratory syndrome virus; identical to SEQ ID NO: 47

SEQ ID NO: 267 - protein, 34 aa, Porcine reproductive and respiratory syndrome virus
LVNANSNSSSHLQLIYNLTICELNGTDWLNNHFS

SEQ ID NO: 268 - protein, 34 aa, Porcine reproductive and respiratory syndrome virus
SFADGNGNSSTYQYIYNLTICELNGTQWLSDQFS

SEQ ID NO: 269 - protein, 34 aa, Porcine reproductive and respiratory syndrome virus
SFADGNGNSSTYQYIYNLTICELNGTGWLSNHFD

SEQ ID NO: 270 - protein, 34 aa, Porcine reproductive and respiratory syndrome virus; identical to SEQ ID NO: 31

SEQ ID NO: 271 - protein, 34 aa, Porcine reproductive and respiratory syndrome virus
SFADGNGNGSTYQYIYNLTICELNGTNWLSDHFD

SEQ ID NO: 272 - protein, 34 aa, Porcine reproductive and respiratory syndrome virus
SFADGNGNSSTYQYIYNLTICELNGTDWLSKHFD

SEQ ID NO: 273 - protein, 34 aa, Porcine reproductive and respiratory syndrome virus; identical to SEQ ID NO: 272

SEQ ID NO: 274 - protein, 34 aa, Porcine reproductive and respiratory syndrome virus
SFADGNGNSSTYQYIYNLTICELNGTDWLSSHFD

SEQ ID NO: 275 - protein, 34 aa, Porcine reproductive and respiratory syndrome virus
SFADGNGNSSTYQYIYNLTICELNGTDWLSNHFD

SEQ ID NO: 276 - protein, 34 aa, Porcine reproductive and respiratory syndrome virus
SFADGNGNNSTYQYIYNLTICELNGTAWLFGHFD

SEQ ID NO: 277 - protein, 34 aa, Porcine reproductive and respiratory syndrome virus
SFADGNGNNSTYQYIYNLTICELNGTEWLSGHFD

SEQ ID NO: 278 - protein, 34 aa, Porcine reproductive and respiratory syndrome virus
SFADGNGNNSTYQYIYNLTICELNGTEWLSDHFD

SEQ ID NO: 279 - protein, 34 aa, Porcine reproductive and respiratory syndrome virus
SFVDGNDTNSTYQYIYNLTICELNGTNWLSDHFE

SEQ ID NO: 280 - protein, 34 aa, Porcine reproductive and respiratory syndrome virus; identical to SEQ ID NO: 238

SEQ ID NO: 281 - protein, 34 aa, Porcine reproductive and respiratory syndrome virus
LVNANSSSSSHFQLIYNLTLCELNGTEWLANKFD

SEQ ID NO: 282 - protein, 34 aa, Porcine reproductive and respiratory syndrome virus
SFADGNGTSSTYQYIYNLTICELKGTDWLSKHFD

SEQ ID NO: 283 - protein, 34 aa, Porcine reproductive and respiratory syndrome virus; identical to SEQ ID NO: 272

SEQ ID NO: 284 - protein, 34 aa, Porcine reproductive and respiratory syndrome virus
SFADGSDNSSTYQYIYNMTICELNGTQWLSGQFD

SEQ ID NO: 285 - protein, 34 aa, Porcine reproductive and respiratory syndrome virus; identical to SEQ ID NO: 284

SEQ ID NO: 286 - protein, 34 aa, Porcine reproductive and respiratory syndrome virus
SFADGNGNSSTYQYIYNLTICELNGISWLPNHFN

SEQ ID NO: 287 - protein, 34 aa, Porcine reproductive and respiratory syndrome virus
SFADGNGNSSTYQYIYNLTICELNGTAWLSGHFD

SEQ ID NO: 288 - protein, 34 aa, Porcine reproductive and respiratory syndrome virus
SFADGNGNSSTYLYIYNLTICELNGTAWLSEHFD

SEQ ID NO: 289 - protein, 34 aa, Porcine reproductive and respiratory syndrome virus
SFADGNGNSSTYQYIYNLTICELNGTTWLQHHFD

SEQ ID NO: 290 - protein, 34 aa, Porcine reproductive and respiratory syndrome virus; identical to SEQ ID NO: 272

SEQ ID NO: 291 - protein, 34 aa, Porcine reproductive and respiratory syndrome virus
SFADGNGNSSTYQYIYNLTICELNETAWLSGHFD

SEQ ID NO: 292 - protein, 34 aa, Porcine reproductive and respiratory syndrome virus
SFADGNGNSSTYQYIYNLTICELNGTSWLSNHFD

SEQ ID NO: 293 - protein, 34 aa, Porcine reproductive and respiratory syndrome virus
SFAVGSGNSSTYQYIYNLTICELNGTAWLHGHFA

SEQ ID NO: 294 - protein, 34 aa, Porcine reproductive and respiratory syndrome virus
SFADGNDNSSTYQYIYNMTICELNGTDWLSGHFD

SEQ ID NO: 295 - protein, 34 aa, Porcine reproductive and respiratory syndrome virus
SSADGNGNSSTYQYIYNLTICELNGTTWLSEHFH

SEQ ID NO: 296 - protein, 34 aa, Porcine reproductive and respiratory syndrome virus
SFADGNGSSSTYQYIYNLTICELNGTSWLSDHFD

SEQ ID NO: 297 - protein, 34 aa, Porcine reproductive and respiratory syndrome virus
SFADGNGNSSTYQYIYNLTICELNGTAWLSSHFS

SEQ ID NO: 298 - protein, 34 aa, Porcine reproductive and respiratory syndrome virus
SFADGNGNSSTYQYIYNLTICELNGTDWLSDHFD

SEQ ID NO: 299 - protein, 34 aa, Porcine reproductive and respiratory syndrome virus
SFADGNGNSSTYLYIYNLTICELNETAWLSEHFD

SEQ ID NO: 300 - protein, 34 aa, Porcine reproductive and respiratory syndrome virus
SFADGNGDSSIYLYIYNLTICELNETAWLSEHFD

SEQ ID NO: 301 - protein, 34 aa, Porcine reproductive and respiratory syndrome virus; identical to SEQ ID NO: 299

SEQ ID NO: 302 - protein, 34 aa, Porcine reproductive and respiratory syndrome virus; identical to SEQ ID NO: 300

SEQ ID NO: 303 - protein, 34 aa, Porcine reproductive and respiratory syndrome virus; identical to SEQ ID NO: 287

SEQ ID NO: 304 - protein, 34 aa, Porcine reproductive and respiratory syndrome virus
SFADGNGNSSTYQYIYDLTICELNGTGWLSNHFD

SEQ ID NO: 305 - protein, 34 aa, Porcine reproductive and respiratory syndrome virus
SFADGNGNSLTYQYIYDLTICELNGTGWLSNHFD

SEQ ID NO: 306 - protein, 34 aa, Porcine reproductive and respiratory syndrome virus; identical to SEQ ID NO: 269

SEQ ID NO: 307 - protein, 34 aa, Porcine reproductive and respiratory syndrome virus
SFADGNGNSSTYQYIYDLTICELNGTGWLFGHFD

SEQ ID NO: 308 - protein, 34 aa, Porcine reproductive and respiratory syndrome virus
SFADGNGNSSTYQYIYNLTICELNGTAWLSNHFN

SEQ ID NO: 309 - protein, 34 aa, Porcine reproductive and respiratory syndrome virus
SFADGNGNSSTYQYIYNLTICELNGTGWLFGHFD

SEQ ID NO: 310 - protein, 34 aa, Porcine reproductive and respiratory syndrome virus
SFADGNGNGSTYQYIYNLTICELNGTDWLSSHFN

SEQ ID NO: 311 - protein, 34 aa, Porcine reproductive and respiratory syndrome virus
SFADGNGDSSTYQYIYDLTICELNGTGWLSNHFD

SEQ ID NO: 312 - protein, 34 aa, Porcine reproductive and respiratory syndrome virus; identical to SEQ ID NO: 272

SEQ ID NO: 313 - protein, 34 aa, Porcine reproductive and respiratory syndrome virus
SFADGNGNSSTYQYIYDLTICELNGTAWLQNHFS

SEQ ID NO: 314 - protein, 34 aa, Porcine reproductive and respiratory syndrome virus
SFADGNGNSSTYQYIYNLTICELNGTDWLSGGFD

SEQ ID NO: 315 - protein, 34 aa, Porcine reproductive and respiratory syndrome virus
SFADGNDNSSTYQYIYNLTICELNGTGWLSNHFD

SEQ ID NO: 316 - protein, 34 aa, Porcine reproductive and respiratory syndrome virus
SFAECNGDSSTYQYIYDLTICELNETAWLSGHFD

SEQ ID NO: 317 - protein, 34 aa, Porcine reproductive and respiratory syndrome virus
SFAECNGNSSTYQYIYDLTICELNETAWLSGHFD

SEQ ID NO: 318 - protein, 34 aa, Porcine reproductive and respiratory syndrome virus; identical to SEQ ID NO: 317

SEQ ID NO: 319 - protein, 33 aa, Porcine reproductive and respiratory syndrome virus
FAECNGNGSTYQYIYNLTICELNGTNWLSNNFD

SEQ ID NO: 320 - protein, 34 aa, Porcine reproductive and respiratory syndrome virus; identical to SEQ ID NO: 269

SEQ ID NO: 321 - protein, 34 aa, Porcine reproductive and respiratory syndrome virus; identical to SEQ ID NO: 287

SEQ ID NO: 322 - protein, 34 aa, Porcine reproductive and respiratory syndrome virus
SFADGNGNSSTYQYIYNLTICELNGTDWLVSHFD

SEQ ID NO: 323 - protein, 34 aa, Porcine reproductive and respiratory syndrome virus
SFADGNGNSSTYQYIYNLTICELNGTEWLSTHFV

SEQ ID NO: 324 - protein, 34 aa, Porcine reproductive and respiratory syndrome virus; identical to SEQ ID NO: 31

SEQ ID NO: 325 - protein, 34 aa, Porcine reproductive and respiratory syndrome virus; identical to SEQ ID NO: 262

SEQ ID NO: 326 - protein, 34 aa, Porcine reproductive and respiratory syndrome virus
SFADGNGNSSTFQYIYNLTICELNGTDWLAGHFD

SEQ ID NO: 327 - protein, 34 aa, Porcine reproductive and respiratory syndrome virus
SSADGNGSSSTYQYIYNLTICELNGTDWLASHFD

SEQ ID NO: 328 - protein, 34 aa, Porcine reproductive and respiratory syndrome virus
SFADGNGNSSTYQYIYNLTICELNGTHWLTSHFD

SEQ ID NO: 329 - protein, 34 aa, Porcine reproductive and respiratory syndrome virus
SFADGNGNSSTYQYIYNLTICELNGTDWLASHFD

SEQ ID NO: 330 - protein, 33 aa, Porcine reproductive and respiratory syndrome virus
FADGNGNSSTYQSIYNLTICELNGTGWLTSHFD

SEQ ID NO: 331 - protein, 34 aa, Porcine reproductive and respiratory syndrome virus
SFADGNGNSSTYQYIYDLTICELNGTGWLSNHFS

SEQ ID NO: 332 - protein, 34 aa, Porcine reproductive and respiratory syndrome virus
SFVDGNDNSSTYQYIYNLTICELNGTAWLSNHFY

SEQ ID NO: 333 - protein, 34 aa, Porcine reproductive and respiratory syndrome virus; identical to SEQ ID NO: 331

SEQ ID NO: 334 - protein, 34 aa, Porcine reproductive and respiratory syndrome virus; identical to SEQ ID NO: 331

SEQ ID NO: 335 - protein, 34 aa, Porcine reproductive and respiratory syndrome virus
SFAVGSGNSSTRQYIYNLTICELNGTTWLSSHFD

SEQ ID NO: 336 - protein, 34 aa, Porcine reproductive and respiratory syndrome virus
SFADGNGNSSTYQYIYNLTICELNGTEWLSSHFD

SEQ ID NO: 337 - protein, 34 aa, Porcine reproductive and respiratory syndrome virus; identical to SEQ ID NO: 336

SEQ ID NO: 338 - protein, 34 aa, Porcine reproductive and respiratory syndrome virus; identical to SEQ ID NO: 31

SEQ ID NO: 339 - protein, 33 aa, Porcine reproductive and respiratory syndrome virus
FVYGNDNSSTYQYIYNLTICELNGTSWLSTHFS

SEQ ID NO: 340 - protein, 34 aa, Porcine reproductive and respiratory syndrome virus
SFADGNGNSSTYQYIYNLTICELNGTAWLFNHFD

SEQ ID NO: 341 - protein, 34 aa, Porcine reproductive and respiratory syndrome virus
SFADGNGNSSTYQYIYNLTICELNGTGWLSNHFE

SEQ ID NO: 342 - protein, 34 aa, Porcine reproductive and respiratory syndrome virus; identical to SEQ ID NO: 143

SEQ ID NO: 343 - protein, 34 aa, Porcine reproductive and respiratory syndrome virus; identical to SEQ ID NO: 31

SEQ ID NO: 344 - protein, 34 aa, Porcine reproductive and respiratory syndrome virus; identical to SEQ ID NO: 22

SEQ ID NO: 345 - protein, 34 aa, Porcine reproductive and respiratory syndrome virus; identical to SEQ ID NO: 39

SEQ ID NO: 346 - protein, 34 aa, Porcine reproductive and respiratory syndrome virus; identical to SEQ ID NO: 58

SEQ ID NO: 347 - protein, 34 aa, Porcine reproductive and respiratory syndrome virus; identical to SEQ ID NO: 55

SEQ ID NO: 348 - protein, 34 aa, Porcine reproductive and respiratory syndrome virus; identical to SEQ ID NO: 58

SEQ ID NO: 349 - protein, 34 aa, Porcine reproductive and respiratory syndrome virus
  MISC_FEATURE (17)..(17): Xaa can be any naturally occurring amino acid
LVNADSNSSSHLQLIYXLTICELNGTDWLNNHFS

SEQ ID NO: 350 - protein, 34 aa, Porcine reproductive and respiratory syndrome virus
LVNASSNSSSHLQLIYNLTICELNGTDWLNDHFS

SEQ ID NO: 351 - protein, 34 aa, Porcine reproductive and respiratory syndrome virus; identical to SEQ ID NO: 64

SEQ ID NO: 352 - protein, 34 aa, Porcine reproductive and respiratory syndrome virus
LVNANSNSSSHLQLIYNLTLCELNGTDWLAGNFD

SEQ ID NO: 353 - protein, 34 aa, Porcine reproductive and respiratory syndrome virus
LVNANSNSSSHFQLIYNLTLCELNGTEWLAKKFD

SEQ ID NO: 354 - protein, 34 aa, Porcine reproductive and respiratory syndrome virus; identical to SEQ ID NO: 353

SEQ ID NO: 355 - protein, 34 aa, Porcine reproductive and respiratory syndrome virus
LVNANSNSSSHFQLIYNLTLCELNGTEWLANKFD

SEQ ID NO: 356 - protein, 34 aa, Porcine reproductive and respiratory syndrome virus
LANANSTSSSHFQLIYNLTICELNGTDWLANKFD

SEQ ID NO: 357 - protein, 34 aa, Porcine reproductive and respiratory syndrome virus
LVSANSNSSSHLQLIYNLTLCELNGTDWLADKFD

SEQ ID NO: 358 - protein, 34 aa, Porcine reproductive and respiratory syndrome virus
LVNANSTSSSQLQLIYNLTLCELNGTDWLANKFD

SEQ ID NO: 359 - protein, 34 aa, Porcine reproductive and respiratory syndrome virus; identical to SEQ ID NO: 47

SEQ ID NO: 360 - protein, 34 aa, Porcine reproductive and respiratory syndrome virus
LVNASSNSSSHLQLIYNLTICELNGTDWLNDKFD

SEQ ID NO: 361 - protein, 34 aa, Porcine reproductive and respiratory syndrome virus
LVDASSNSSSHLQLIYNLTICELNGTDWLNNKFD

SEQ ID NO: 362 - protein, 34 aa, Porcine reproductive and respiratory syndrome virus
LVNAGSNSSSHLQLIYNLTICELNGTDWLNDKFD

SEQ ID NO: 363 - protein, 34 aa, Porcine reproductive and respiratory syndrome virus
LVNANSNSGSHLQLIYNLTLCELNGTDWLKDKFD

SEQ ID NO: 364 - protein, 34 aa, Porcine reproductive and respiratory syndrome virus
LVNANNDSSSHLQLIYSLTICELNGTEWLNEHFS

SEQ ID NO: 365 - protein, 34 aa, Porcine reproductive and respiratory syndrome virus
SFVDGNDSSSTYQYIYNLTICELNGTEWLPTHFD

SEQ ID NO: 366 - protein, 34 aa, Porcine reproductive and respiratory syndrome virus
SFADGNGNSSTYQYIYNLTICELNGTAWLSTHFD

SEQ ID NO: 367 - protein, 34 aa, Porcine reproductive and respiratory syndrome virus; identical to SEQ ID NO: 366

SEQ ID NO: 368 - protein, 34 aa, Porcine reproductive and respiratory syndrome virus
SFADGNGNSSTYQYIYDLTLCELNGTDWLSDHFE

SEQ ID NO: 369 - protein, 34 aa, Porcine reproductive and respiratory syndrome virus
SFADGNGNSSTYQYIYNLTLCELNGTDWLSGHFE

SEQ ID NO: 370 - protein, 34 aa, Porcine reproductive and respiratory syndrome virus
SFADGNGNSSTYQYIYNLTICELNGTEWLSSHFS

SEQ ID NO: 371 - protein, 34 aa, Porcine reproductive and respiratory syndrome virus; identical to SEQ ID NO: 370

SEQ ID NO: 372 - protein, 34 aa, Porcine reproductive and respiratory syndrome virus
SFADGNNDSSTYQYIYNLTICELNGTAWLFDHFD

SEQ ID NO: 373 - protein, 34 aa, Porcine reproductive and respiratory syndrome virus
SFANGNGNSSTYQFIYNMTICELNGTDWLSNNFN

SEQ ID NO: 374 - protein, 34 aa, Porcine reproductive and respiratory syndrome virus; identical to SEQ ID NO: 31

SEQ ID NO: 375 - protein, 34 aa, Porcine reproductive and respiratory syndrome virus
SFADGNGNSSTFQYIYNLTVCELNGTDWLSGHFS

SEQ ID NO: 376 - protein, 34 aa, Porcine reproductive and respiratory syndrome virus; identical to SEQ ID NO: 375

SEQ ID NO: 377 - protein, 32 aa, Porcine reproductive and respiratory syndrome virus
AAANGNSSTLQYIYNLTICELNGTDWLVGKFD

SEQ ID NO: 378 - protein, 34 aa, Porcine reproductive and respiratory syndrome virus
SFADGNGNSSTYQYIYNLTICELNGTEWLSSNFY

SEQ ID NO: 379 - protein, 34 aa, Porcine reproductive and respiratory syndrome virus; identical to SEQ ID NO: 260

SEQ ID NO: 380 - protein, 34 aa, Porcine reproductive and respiratory syndrome virus
SFVDGNDNSSTYQYIYNLTICELNGTAWLSSHFN

SEQ ID NO: 381 - protein, 34 aa, Porcine reproductive and respiratory syndrome virus
SFADGNGNSSTYQYIYNLTICELNGIQWLSDRFY

SEQ ID NO: 382 - protein, 34 aa, Porcine reproductive and respiratory syndrome virus
SFAAANGNSSTHQYIYNLTICELNGTDWLQGKFE

SEQ ID NO: 383 - protein, 34 aa, Porcine reproductive and respiratory syndrome virus
SFADGNGNSSTYQYIYNLTICELNGTAWLFDHFD

SEQ ID NO: 384 - protein, 34 aa, Porcine reproductive and respiratory syndrome virus
SFADGNGNSSTYQYIYNLTICELNGTKWLTSHFD

SEQ ID NO: 385 - protein, 34 aa, Porcine reproductive and respiratory syndrome virus
SFADGNGNSSTYQYIYNLTICELNGTEWLTSHFD

SEQ ID NO: 386 - protein, 34 aa, Porcine reproductive and respiratory syndrome virus
SFADGNGNSSTYQYIYDLTICELNGTNWLASRFS

SEQ ID NO: 387 - protein, 34 aa, Porcine reproductive and respiratory syndrome virus
SFADGNGNSSTYQYIYNLTICELNGTDWLASHFS

SEQ ID NO: 388 - protein, 34 aa, Porcine reproductive and respiratory syndrome virus
SFADGNGNSSTYQYIYNLTICELNGTDWLSGHFD

SEQ ID NO: 389 - protein, 34 aa, Porcine reproductive and respiratory syndrome virus; identical to SEQ ID NO: 287

SEQ ID NO: 390 - protein, 34 aa, Porcine reproductive and respiratory syndrome virus
SFVDGNDDSSTYQYIYNLTICELNGTEWLSSHFD

SEQ ID NO: 391 - protein, 34 aa, Porcine reproductive and respiratory syndrome virus; identical to SEQ ID NO: 26

SEQ ID NO: 392 - protein, 34 aa, Porcine reproductive and respiratory syndrome virus; identical to SEQ ID NO: 23

SEQ ID NO: 393 - protein, 34 aa, Porcine reproductive and respiratory syndrome virus; identical to SEQ ID NO: 390

SEQ ID NO: 394 - protein, 34 aa, Porcine reproductive and respiratory syndrome virus
SFVDGDDNSSTYQYIYNLTICELNGTNWLSSHFD

SEQ ID NO: 395 - protein, 34 aa, Porcine reproductive and respiratory syndrome virus
SFADGNGNSSTYQYIYNLTICELNGTDWLSSHFS

SEQ ID NO: 396 - protein, 34 aa, Porcine reproductive and respiratory syndrome virus; identical to SEQ ID NO: 31

SEQ ID NO: 397 - protein, 34 aa, Porcine reproductive and respiratory syndrome virus
SFADGNGNSSTRQYIYNLTICELNGTTWLTGHFD

SEQ ID NO: 398 - protein, 34 aa, Porcine reproductive and respiratory syndrome virus; identical to SEQ ID NO: 31

SEQ ID NO: 399 - protein, 34 aa, Porcine reproductive and respiratory syndrome virus
SFADGNGNSSTYQYIYNLTICELNGTAWLSSHFD

SEQ ID NO: 400 - protein, 34 aa, Porcine reproductive and respiratory syndrome virus
SFADGSGDSSTYQYIYNLTICELNGTAWLSSHFY

SEQ ID NO: 401 - protein, 34 aa, Porcine reproductive and respiratory syndrome virus; identical to SEQ ID NO: 22

SEQ ID NO: 402 - protein, 34 aa, Porcine reproductive and respiratory syndrome virus
SFADGNGNSSTYQYIYNLTICELNGTKWLSSHFD

SEQ ID NO: 403 - protein, 34 aa, Porcine reproductive and respiratory syndrome virus
SFADGNGNSSTYQYIYNLTICELNGTTWLTSHFD

SEQ ID NO: 404 - protein, 34 aa, Porcine reproductive and respiratory syndrome virus; identical to SEQ ID NO: 213

SEQ ID NO: 405 - protein, 34 aa, Porcine reproductive and respiratory syndrome virus
SFADGNGNSSTYQYIYNLTICELNGTEWLSNHFG

SEQ ID NO: 406 - protein, 34 aa, Porcine reproductive and respiratory syndrome virus
SFADGSGNSSTYQYIYNLTICELNGTKWLSSHFG

SEQ ID NO: 407 - protein, 34 aa, Porcine reproductive and respiratory syndrome virus
SFADGNGNGSTYQYIYNLTICELNGTTWLTSHFD

SEQ ID NO: 408 - protein, 34 aa, Porcine reproductive and respiratory syndrome virus
SFVDGNGNSSTYQYIYNLTICELNGTEWLSSHFD

SEQ ID NO: 409 - protein, 34 aa, Porcine reproductive and respiratory syndrome virus
SFADGNDNSSTYQYIYNLTICELNGTEWLSSHFG

SEQ ID NO: 410 - protein, 34 aa, Porcine reproductive and respiratory syndrome virus
SFVDGSDNSSTYQYIYNLTICELNGTHWLSDHFG

SEQ ID NO: 411 - protein, 34 aa, Porcine reproductive and respiratory syndrome virus
SFADGNGNSSTYLYIYNLTICELNGTLWLSNHFD

SEQ ID NO: 412 - protein, 34 aa, Porcine reproductive and respiratory syndrome virus
SFADGNGNSSTYQYIYNLTICELNGTAWLSSHFE

SEQ ID NO: 413 - protein, 34 aa, Porcine reproductive and respiratory syndrome virus
SFADGNGNSSTYQYIYNLTICELNGTEWLSSHFG

SEQ ID NO: 414 - protein, 34 aa, Porcine reproductive and respiratory syndrome virus
SFADGNGNSSTYQYIYNLTICELNGTEWLASHFD

SEQ ID NO: 415 - protein, 34 aa, Porcine reproductive and respiratory syndrome virus; identical to SEQ ID NO: 399

SEQ ID NO: 416 - protein, 31 aa, Porcine reproductive and respiratory syndrome virus
DGNGNSSTYQYIYNLTICELNGTDWLSTHFD

SEQ ID NO: 417 - protein, 31 aa, Porcine reproductive and respiratory syndrome virus
DGNGNSSTYQYIYNLTICELNGTEWLAIHFD

SEQ ID NO: 418 - protein, 31 aa, Porcine reproductive and respiratory syndrome virus
DGNGNSSTYQYIYNLTICELNGTDWLSNHFG

SEQ ID NO: 419 - protein, 31 aa, Porcine reproductive and respiratory syndrome virus
DGNGNSSTYQYIYNLTICELNGTDWLSDHFV

SEQ ID NO: 420 - protein, 31 aa, Porcine reproductive and respiratory syndrome virus
DGNGNSSTYQYIYDLTICELNGTEWLSSHFD

SEQ ID NO: 421 - protein, 31 aa, Porcine reproductive and respiratory syndrome virus
DGNDNSSTYQYIYKLTICELNGTEWLSSHFD

SEQ ID NO: 422 - protein, 31 aa, Porcine reproductive and respiratory syndrome virus
DGNDNSSTYQYIYKLTICELNGTEWLSNHFD

SEQ ID NO: 423 - protein, 31 aa, Porcine reproductive and respiratory syndrome virus
DGNDSSSTYQYIYNLTICELNGTEWLLSHFD

SEQ ID NO: 424 - protein, 31 aa, Porcine reproductive and respiratory syndrome virus
DGNGNSSTYQYIYNLTICELNGTDWLSSHFV

SEQ ID NO: 425 - protein, 31 aa, Porcine reproductive and respiratory syndrome virus
DGSGNSSTYQYIYNLTICELNGTTWLSGHFD

SEQ ID NO: 426 - protein, 31 aa, Porcine reproductive and respiratory syndrome virus
DGNGNSSTYQYIYNLTICELNGTQWLSGHFD

SEQ ID NO: 427 - protein, 31 aa, Porcine reproductive and respiratory syndrome virus
DGNGNSSTYQYIYNLTICELNGTDWLSDHFG

SEQ ID NO: 428 - protein, 34 aa, Porcine reproductive and respiratory syndrome virus; identical to SEQ ID NO: 256

SEQ ID NO: 429 - protein, 27 aa, Porcine reproductive and respiratory syndrome virus
NSSTYQYIYKLTICELNGTEWLSSHFD

SEQ ID NO: 430 - protein, 27 aa, Porcine reproductive and respiratory syndrome virus
NSSTYQYIYKLTICELNGTEWLSNHFD

SEQ ID NO: 431 - protein, 27 aa, Porcine reproductive and respiratory syndrome virus
NSSTYQYIYNLTICELNGTEWLSNHFD

SEQ ID NO: 432 - protein, 34 aa, Porcine reproductive and respiratory syndrome virus
SFADGNGNSSTYQYIYNLTICELNGTTWLSDHFY

SEQ ID NO: 433 - protein, 34 aa, Porcine reproductive and respiratory syndrome virus; identical to SEQ ID NO: 275

SEQ ID NO: 434 - protein, 34 aa, Porcine reproductive and respiratory syndrome virus
SFADGNGNSSTYQYIYNLTICELNGTAWLSNKFD

SEQ ID NO: 435 - protein, 34 aa, Porcine reproductive and respiratory syndrome virus
SFADGNGNSSTYQYIYNLTICELNGTKWLSGHFD

SEQ ID NO: 436 - protein, 34 aa, Porcine reproductive and respiratory syndrome virus
SSADGNGDSSTYQYIYDLTICELNGTGWLSSHFD

SEQ ID NO: 437 - protein, 34 aa, Porcine reproductive and respiratory syndrome virus
SFADGNGNSSTYQYIYNLTICELNGTKWLSEHFD

SEQ ID NO: 438 - protein, 34 aa, Porcine reproductive and respiratory syndrome virus
SFAEGTGNSSTYQYIYDLTICELNGTGWLSTHFD

SEQ ID NO: 439 - protein, 34 aa, Porcine reproductive and respiratory syndrome virus
SFADGNGNSSTYQYIYNLTICELNGTNWLSGHFD

SEQ ID NO: 440 - protein, 34 aa, Porcine reproductive and respiratory syndrome virus
SFADGNGNSSTYQYIYNLTICELNGTDWLSNHFY

SEQ ID NO: 441 - protein, 32 aa, Porcine reproductive and respiratory syndrome virus
ADGNGNSSTYQYIYNLTICELNGTQWLSAHFS

SEQ ID NO: 442 - protein, 34 aa, Porcine reproductive and respiratory syndrome virus
SFADGNGNSSTYQYIYKLTICELNGTAWLSNHFY

SEQ ID NO: 443 - protein, 34 aa, Porcine reproductive and respiratory syndrome virus; identical to SEQ ID NO: 188

SEQ ID NO: 444 - protein, 34 aa, Porcine reproductive and respiratory syndrome virus
FVSANNNSSSHLQLIYNLTLCELNGTDWLANKFD

SEQ ID NO: 445 - protein, 34 aa, Porcine reproductive and respiratory syndrome virus
LVSASTNSSSHLQLIYNLTLCELNGTDWLANKFD

SEQ ID NO: 446 - protein, 33 aa, Porcine reproductive and respiratory syndrome virus
VNANSDSSSHFQLIYNLTLCELNGTDWLANKFD

SEQ ID NO: 447 - protein, 34 aa, Porcine reproductive and respiratory syndrome virus; identical to SEQ ID NO: 44

SEQ ID NO: 448 - protein, 34 aa, Porcine reproductive and respiratory syndrome virus
IVNATGNSSSHFQLIYNLTLCELNGTDWLANKFD

SEQ ID NO: 449 - protein, 34 aa, Porcine reproductive and respiratory syndrome virus
LVNASSNNSSHLQLIYNLTICELNGTDWLDKHFS

SEQ ID NO: 450 - protein, 34 aa, Porcine reproductive and respiratory syndrome virus
LVNADNSSSSHLQLIYNLTICELNGTDWLNEKFD

SEQ ID NO: 451 - protein, 34 aa, Porcine reproductive and respiratory syndrome virus
IVNANSNSSSHIQLIYNLTLCELNGTDWLAGKFD

SEQ ID NO: 452 - protein, 34 aa, Porcine reproductive and respiratory syndrome virus
LVNASSNRSSHLQLIYNLTLCELNGTDWLKDKFD

SEQ ID NO: 453 - protein, 34 aa, Porcine reproductive and respiratory syndrome virus
IVNASGNSSSHFQLIYNLTLCELNGTDWLAKKFD

SEQ ID NO: 454 - protein, 34 aa, Porcine reproductive and respiratory syndrome virus; identical to SEQ ID NO: 75

SEQ ID NO: 455 - protein, 34 aa, Porcine reproductive and respiratory syndrome virus; identical to SEQ ID NO: 47

SEQ ID NO: 456 - protein, 34 aa, Porcine reproductive and respiratory syndrome virus
LVNASSNSSSHLQLIYNLTICELNGTDWLNNTFD

SEQ ID NO: 457 - protein, 34 aa, Porcine reproductive and respiratory syndrome virus
LVNANSNSSSHLQLIYNLTLCELNGTEWLSEKFD

SEQ ID NO: 458 - protein, 34 aa, Porcine reproductive and respiratory syndrome virus; identical to SEQ ID NO: 47

SEQ ID NO: 459 - protein, 34 aa, Porcine reproductive and respiratory syndrome virus
IVNANSNSSSHFQLIYNLTICELNGTDWLKQKFD

SEQ ID NO: 460 - protein, 34 aa, Porcine reproductive and respiratory syndrome virus
IVNANSNSSSHFQLIYDLTICELNGTDWLSQKFD

SEQ ID NO: 461 - protein, 34 aa, Porcine reproductive and respiratory syndrome virus
LVNANSNSSSHLQLIYNLTICELNGTDWLNSHFS

SEQ ID NO: 462 - protein, 34 aa, Porcine reproductive and respiratory syndrome virus
LVNASNGSSSHLQLIYNLTLCELNGTDWLANKFD

SEQ ID NO: 463 - protein, 34 aa, Porcine reproductive and respiratory syndrome virus
LVDADSNSSSHFQLIYNLTLCELNGTDWLKDKFD

SEQ ID NO: 464 - protein, 34 aa, Porcine reproductive and respiratory syndrome virus
LVNANSSSSSHFQLIYNLTLCELNGTDWLGNKFD

SEQ ID NO: 465 - protein, 34 aa, Porcine reproductive and respiratory syndrome virus
LVGANSNSSSHFQLIYNLTLCELNGTDWLGDKFD

SEQ ID NO: 466 - protein, 34 aa, Porcine reproductive and respiratory syndrome virus
LVGANSNSSSHFQLIYNLTLCELNGTDWLGNKFD

SEQ ID NO: 467 - protein, 34 aa, Porcine reproductive and respiratory syndrome virus
LVGANSNSSSHFQLIYNLTLCELNGTDWLNDKFS

SEQ ID NO: 468 - protein, 34 aa, Porcine reproductive and respiratory syndrome virus
LVNANSNSSSHLQLIYNLTICELNGTEWLGNHFS

SEQ ID NO: 469 - protein, 34 aa, Porcine reproductive and respiratory syndrome virus
LVNASNNSSSHLQLIYNLTICELNGTDWLDKHFS

SEQ ID NO: 470 - protein, 34 aa, Porcine reproductive and respiratory syndrome virus
LVNANSNSSSHLQLIYNLTLCELNGTDWLKDKFN

SEQ ID NO: 471 - protein, 34 aa, Porcine reproductive and respiratory syndrome virus; identical to SEQ ID NO: 188

SEQ ID NO: 472 - protein, 34 aa, Porcine reproductive and respiratory syndrome virus; identical to SEQ ID NO: 188

SEQ ID NO: 473 - protein, 34 aa, Porcine reproductive and respiratory syndrome virus
LVNANSSSSSHLQLIYNLTLCELNGTDWLKDKFD

SEQ ID NO: 474 - protein, 34 aa, Porcine reproductive and respiratory syndrome virus
LVNASSNSSSHLQLIYNLTLCELNGTDWLKGKFD

SEQ ID NO: 475 - protein, 34 aa, Porcine reproductive and respiratory syndrome virus
LVNASSNSSSHLQLIYNLTLCELNGTDWLKDKFD

SEQ ID NO: 476 - protein, 34 aa, Porcine reproductive and respiratory syndrome virus
LVNANSNSSSHLQLIYNLTLCELNGTDWLKGKFD

SEQ ID NO: 477 - protein, 34 aa, Porcine reproductive and respiratory syndrome virus
LVGADSNSSSHFQLIYNLTLCELNGTDWLSDKFD

SEQ ID NO: 478 - protein, 34 aa, Porcine reproductive and respiratory syndrome virus; identical to SEQ ID NO: 188

SEQ ID NO: 479 - protein, 34 aa, Porcine reproductive and respiratory syndrome virus; identical to SEQ ID NO: 475

SEQ ID NO: 480 - protein, 34 aa, Porcine reproductive and respiratory syndrome virus
PANAGNNSSSHLQLIYNLTLCELNGTDWLADKFD

SEQ ID NO: 481 - protein, 34 aa, Porcine reproductive and respiratory syndrome virus
IVNANSNSSSQFQLIYNLTICELNGTDWLADKFD

SEQ ID NO: 482 - protein, 34 aa, Porcine reproductive and respiratory syndrome virus
LVNADSNNSSHLQLIYNLTICELNGTDWLDNHFS

SEQ ID NO: 483 - protein, 34 aa, Porcine reproductive and respiratory syndrome virus
IVNANSNSSSHFQLIYNLTICELNGTDWLNHKFD

SEQ ID NO: 484 - protein, 34 aa, Porcine reproductive and respiratory syndrome virus
LANASNNSSSHLQLIYNLTLCELNGTDWLADKFD

SEQ ID NO: 485 - protein, 34 aa, Porcine reproductive and respiratory syndrome virus
LVNASSNSSSHFQLIYNLTICELNGTDWLNKKFD

SEQ ID NO: 486 - protein, 34 aa, Porcine reproductive and respiratory syndrome virus
LVNADSNSSSHLQLIYNLTICELNGTDWLNNHFS

SEQ ID NO: 487 - protein, 34 aa, Porcine reproductive and respiratory syndrome virus
LVNADSNSSSHLQLIYNLTICELNGTEWLNNHFS

SEQ ID NO: 488 - protein, 34 aa, Porcine reproductive and respiratory syndrome virus
LVNANSNSSSHLQLIYNLTLCELNGTDWLKNRFD

SEQ ID NO: 489 - protein, 34 aa, Porcine reproductive and respiratory syndrome virus; identical to SEQ ID NO: 267

SEQ ID NO: 490 - protein, 34 aa, Porcine reproductive and respiratory syndrome virus; identical to SEQ ID NO: 267

SEQ ID NO: 491 - protein, 34 aa, Porcine reproductive and respiratory syndrome virus
LVNANSNSSSHFQLIYNLTLCELNGTDWLADRFD

SEQ ID NO: 492 - protein, 34 aa, Porcine reproductive and respiratory syndrome virus; identical to SEQ ID NO: 55

SEQ ID NO: 493 - protein, 34 aa, Porcine reproductive and respiratory syndrome virus
LVNASNSSSSHLQLIYNLTLCELNGTDWLANKFD

SEQ ID NO: 494 - protein, 34 aa, Porcine reproductive and respiratory syndrome virus
FVNADSNSSSHLQLIYNLTLCELNGTDWLAQRFD

SEQ ID NO: 495 - protein, 34 aa, Porcine reproductive and respiratory syndrome virus
LVNASNSSSSHLQLIYNLTICELNGTDWLSHKFD

SEQ ID NO: 496 - protein, 34 aa, Porcine reproductive and respiratory syndrome virus; identical to SEQ ID NO: 47

SEQ ID NO: 497 - protein, 34 aa, Porcine reproductive and respiratory syndrome virus; identical to SEQ ID NO: 55

SEQ ID NO: 498 - protein, 34 aa, Porcine reproductive and respiratory syndrome virus
LVNANSASSSHFQLIYNLTLCELNGTDWLNDKFS

SEQ ID NO: 499 - protein, 34 aa, Porcine reproductive and respiratory syndrome virus
LVNADSNNSSHLQLIYNLTICELNGTDWLNNHFS

SEQ ID NO: 500 - protein, 34 aa, Porcine reproductive and respiratory syndrome virus; identical to SEQ ID NO: 475

SEQ ID NO: 501 - protein, 34 aa, Porcine reproductive and respiratory syndrome virus
LVNANSNSSSHFQLIYNLTICELNGTDWLNKKFD

SEQ ID NO: 502 - protein, 34 aa, Porcine reproductive and respiratory syndrome virus
LVNANSNSSSHLQLIYNLTLCELNGTDWLADKFD

SEQ ID NO: 503 - protein, 34 aa, Porcine reproductive and respiratory syndrome virus; identical to SEQ ID NO: 502

SEQ ID NO: 504 - protein, 34 aa, Porcine reproductive and respiratory syndrome virus; identical to SEQ ID NO: 47

SEQ ID NO: 505 - protein, 34 aa, Porcine reproductive and respiratory syndrome virus; identical to SEQ ID NO: 502

SEQ ID NO: 506 - protein, 34 aa, Porcine reproductive and respiratory syndrome virus; identical to SEQ ID NO: 502

SEQ ID NO: 507 - protein, 34 aa, Porcine reproductive and respiratory syndrome virus; identical to SEQ ID NO: 502

SEQ ID NO: 508 - protein, 34 aa, Porcine reproductive and respiratory syndrome virus
LANASHNSSSHLQLIYNLTLCELNGTDWLANKFD

SEQ ID NO: 509 - protein, 34 aa, Porcine reproductive and respiratory syndrome virus
LVNANSSSSSHLQLIYNLTLCELNGTDWLKNKFD

SEQ ID NO: 510 - protein, 34 aa, Porcine reproductive and respiratory syndrome virus; identical to SEQ ID NO: 68

SEQ ID NO: 511 - protein, 34 aa, Porcine reproductive and respiratory syndrome virus; identical to SEQ ID NO: 188

SEQ ID NO: 512 - protein, 34 aa, Porcine reproductive and respiratory syndrome virus; identical to SEQ ID NO: 188

SEQ ID NO: 513 - protein, 34 aa, Porcine reproductive and respiratory syndrome virus
LVNANSNSSSHLQLIYNLTLCELNGTDWLKNKFD

SEQ ID NO: 514 - protein, 34 aa, Porcine reproductive and respiratory syndrome virus; identical to SEQ ID NO: 188

SEQ ID NO: 515 - protein, 34 aa, Porcine reproductive and respiratory syndrome virus; identical to SEQ ID NO: 467

SEQ ID NO: 516 - protein, 34 aa, Porcine reproductive and respiratory syndrome virus; identical to SEQ ID NO: 470

SEQ ID NO: 517 - protein, 34 aa, Porcine reproductive and respiratory syndrome virus; identical to SEQ ID NO: 188

SEQ ID NO: 518 - protein, 34 aa, Porcine reproductive and respiratory syndrome virus; identical to SEQ ID NO: 466

SEQ ID NO: 519 - protein, 34 aa, Porcine reproductive and respiratory syndrome virus
LVNASSNSSSHLQLIYNLTLCELNGTDWLKNKFD

SEQ ID NO: 520 - protein, 34 aa, Porcine reproductive and respiratory syndrome virus; identical to SEQ ID NO: 444

SEQ ID NO: 521 - protein, 34 aa, Porcine reproductive and respiratory syndrome virus; identical to SEQ ID NO: 484

SEQ ID NO: 522 - protein, 34 aa, Porcine reproductive and respiratory syndrome virus
LANASNESSSHLQLIYNLTLCELNGTDWLANKFD

SEQ ID NO: 523 - protein, 34 aa, Porcine reproductive and respiratory syndrome virus
IVNASGNSSSHFQLIYNLTLCELNGTDWLADKFD

SEQ ID NO: 524 - protein, 34 aa, Porcine reproductive and respiratory syndrome virus; identical to SEQ ID NO: 227

SEQ ID NO: 525 - protein, 34 aa, Porcine reproductive and respiratory syndrome virus
PVNADTNNSSKLQLIYNLTLCELNGTDWLADRFN

SEQ ID NO: 526 - protein, 34 aa, Porcine reproductive and respiratory syndrome virus
IVNANGNSSSHIQLIYNLTLCELNGTBWLAKKFD

SEQ ID NO: 527 - protein, 34 aa, Porcine reproductive and respiratory syndrome virus
LVNANSTSSSHIQLIYNLTLCELNGTDWLKNKFD

SEQ ID NO: 528 - protein, 34 aa, Porcine reproductive and respiratory syndrome virus
LVNANSTSSSHIQLIYNLTLCELNGTDWLNNKFD

SEQ ID NO: 529 - protein, 34 aa, Porcine reproductive and respiratory syndrome virus; identical to SEQ ID NO: 188

SEQ ID NO: 530 - protein, 34 aa, Porcine reproductive and respiratory syndrome virus; identical to SEQ ID NO: 475

SEQ ID NO: 531 - protein, 34 aa, Porcine reproductive and respiratory syndrome virus; identical to SEQ ID NO: 188

SEQ ID NO: 532 - protein, 33 aa, Porcine reproductive and respiratory syndrome virus
VNASSNSSSHFQLIYNLTLCELNGTDWLVNKFD

SEQ ID NO: 533 - protein, 34 aa, Porcine reproductive and respiratory syndrome virus
LVNASYNNSSHLQLIYNLTLCELNGTDWLANKFD

SEQ ID NO: 534 - protein, 34 aa, Porcine reproductive and respiratory syndrome virus
LVDANSNSSSHFQLIYNLTLCELNGTDWLANKFD

SEQ ID NO: 535 - protein, 34 aa, Porcine reproductive and respiratory syndrome virus; identical to SEQ ID NO: 484

SEQ ID NO: 536 - protein, 34 aa, Porcine reproductive and respiratory syndrome virus; identical to SEQ ID NO: 75

SEQ ID NO: 537 - protein, 34 aa, Porcine reproductive and respiratory syndrome virus
LVNANSNSSSHFQSIYNLTLCELNGTEWLNDHFN

SEQ ID NO: 538 - protein, 34 aa, Porcine reproductive and respiratory syndrome virus
IVNANSNSSSHFQLIYNLTLCELNGTDWLNKKFD

SEQ ID NO: 539 - protein, 34 aa, Porcine reproductive and respiratory syndrome virus
IVNANSNSSSHFQLIYNLTLCELNGTDWLNEKFD

SEQ ID NO: 540 - protein, 34 aa, Porcine reproductive and respiratory syndrome virus
LVNANSSSSSHLQLIYNLTLCELNGTDWLADKFD

SEQ ID NO: 541 - protein, 34 aa, Porcine reproductive and respiratory syndrome virus; identical to SEQ ID NO: 55

SEQ ID NO: 542 - protein, 34 aa, Porcine reproductive and respiratory syndrome virus
IVNASSNSSSHFQLIYNLTLCELNGTDWLANKFD

SEQ ID NO: 543 - protein, 34 aa, Porcine reproductive and respiratory syndrome virus; identical to SEQ ID NO: 47

SEQ ID NO: 544 - protein, 34 aa, Porcine reproductive and respiratory syndrome virus
IVNASSNSSSHFQLIYNLTLCELNGTEWLADKFD

SEQ ID NO: 545 - protein, 34 aa, Porcine reproductive and respiratory syndrome virus
LVNASANSSSHLQLIYNLTICELNGTDWLGKKFD

SEQ ID NO: 546 - protein, 34 aa, Porcine reproductive and respiratory syndrome virus
LVNANSTSSSHFQLIYNLTLCELNGTDWLAGKFD

SEQ ID NO: 547 - protein, 34 aa, Porcine reproductive and respiratory syndrome virus; identical to SEQ ID NO: 47

SEQ ID NO: 548 - protein, 34 aa, Porcine reproductive and respiratory syndrome virus; identical to SEQ ID NO: 39

SEQ ID NO: 549 - protein, 34 aa, Porcine reproductive and respiratory syndrome virus; identical to SEQ ID NO: 544

SEQ ID NO: 550 - protein, 34 aa, Porcine reproductive and respiratory syndrome virus
LVNANSNSSSHFQLIYNLTLCELNGTDWLSDKFD

SEQ ID NO: 551 - protein, 34 aa, Porcine reproductive and respiratory syndrome virus; identical to SEQ ID NO: 39

SEQ ID NO: 552 - protein, 34 aa, Porcine reproductive and respiratory syndrome virus; identical to SEQ ID NO: 188

SEQ ID NO: 553 - protein, 34 aa, Porcine reproductive and respiratory syndrome virus; identical to SEQ ID NO: 55

SEQ ID NO: 554 - protein, 34 aa, Porcine reproductive and respiratory syndrome virus
LVNANNNSSSHLQLIYNLTICELNGTDWLKDKFD

SEQ ID NO: 555 - protein, 34 aa, Porcine reproductive and respiratory syndrome virus
IVNANSNSSSHFQLIYNLTLCELNGTDWLVDKFD

SEQ ID NO: 556 - protein, 34 aa, Porcine reproductive and respiratory syndrome virus
LVNANSNSSSHFQLIYNLTLCELNGTDWLSNKFD

SEQ ID NO: 557 - protein, 34 aa, Porcine reproductive and respiratory syndrome virus; identical to SEQ ID NO: 47

SEQ ID NO: 558 - protein, 34 aa, Porcine reproductive and respiratory syndrome virus
LVDANSNSSSHFQLIYNLTLCELNGTDWLGKKFD

SEQ ID NO: 559 - protein, 34 aa, Porcine reproductive and respiratory syndrome virus
LVNASSNHSSHLQLIYNLTLCELNGTDWLENKFD

SEQ ID NO: 560 - protein, 34 aa, Porcine reproductive and respiratory syndrome virus
LVNANSNSSSHFQLIYNLTLCELNGTDWLADKFD

SEQ ID NO: 561 - protein, 34 aa, Porcine reproductive and respiratory syndrome virus
LVNANSSSSSHFQLIYNLTLCELNGTDWLAKKFD

SEQ ID NO: 562 - protein, 34 aa, Porcine reproductive and respiratory syndrome virus; identical to SEQ ID NO: 47

SEQ ID NO: 563 - protein, 34 aa, Porcine reproductive and respiratory syndrome virus
LANASNNSSSHLQLIYNLTLCELNGTDWLANRFD

SEQ ID NO: 564 - protein, 34 aa, Porcine reproductive and respiratory syndrome virus
LVNASNNSSSHLQLIYNLTLCELNGTDWLADKFD

SEQ ID NO: 565 - protein, 34 aa, Porcine reproductive and respiratory syndrome virus
LVNANSSSSSHFQLIYNLTLCELNGTDWLSNKFD

SEQ ID NO: 566 - protein, 34 aa, Porcine reproductive and respiratory syndrome virus; identical to SEQ ID NO: 223

SEQ ID NO: 567 - protein, 34 aa, Porcine reproductive and respiratory syndrome virus
LVNANSNSSSHFQLIYNLTLCELNGTDWLGNKFD

SEQ ID NO: 568 - protein, 34 aa, Porcine reproductive and respiratory syndrome virus
LVNANSNSSSHFQLIYNLTLCELNGTDWLTNKFD

SEQ ID NO: 569 - protein, 34 aa, Porcine reproductive and respiratory syndrome virus
LVNASSNSSSHFQLIYNLTLCELNGTDWLSNKFD

SEQ ID NO: 570 - protein, 34 aa, Porcine reproductive and respiratory syndrome virus
LVNANSNSSSHFQLIYNLTLCELNGTDWLADKFN

SEQ ID NO: 571 - protein, 34 aa, Porcine reproductive and respiratory syndrome virus
LVNANSNSSSHFQLIYNLTLCELNGTDWLKEKFD

SEQ ID NO: 572 - protein, 34 aa, Porcine reproductive and respiratory syndrome virus
LVNANSNSSSHFQLIYNLTLCELNGTDWLAKKFD

SEQ ID NO: 573 - protein, 34 aa, Porcine reproductive and respiratory syndrome virus
IVNASSNSSSHLQLIYKLTLCELNGTDWLANKFD

SEQ ID NO: 574 - protein, 34 aa, Porcine reproductive and respiratory syndrome virus
LVNANSNSSSHFQLIYNLTLCELNGTEWLADKFD

SEQ ID NO: 575 - protein, 34 aa, Porcine reproductive and respiratory syndrome virus; identical to SEQ ID NO: 75

SEQ ID NO: 576 - protein, 34 aa, Porcine reproductive and respiratory syndrome virus; identical to SEQ ID NO: 243

SEQ ID NO: 577 - protein, 34 aa, Porcine reproductive and respiratory syndrome virus
IVNANSNSSSHIQLIYNLTLCELNGTDWLAEKFD

SEQ ID NO: 578 - protein, 34 aa, Porcine reproductive and respiratory syndrome virus
LVNASSNSSSHFQLIYNLTLCELNGTDWLKDKFD

SEQ ID NO: 579 - protein, 34 aa, Porcine reproductive and respiratory syndrome virus
IVNANSNSSSHLQLIYNLTLCELNGTDWLAKKFD

SEQ ID NO: 580 - protein, 34 aa, Porcine reproductive and respiratory syndrome virus
LVNASGNSSSHLQLIYNLTLCELNGTDWLANKFD

SEQ ID NO: 581 - protein, 34 aa, Porcine reproductive and respiratory syndrome virus
LVNASGNSSSHLQLIYNLTICELNGTDWLDKKFD

SEQ ID NO: 582 - protein, 34 aa, Porcine reproductive and respiratory syndrome virus
LVNANNSSSSHFQLIYNLTLCELNGTDWLAKKFD

SEQ ID NO: 583 - protein, 34 aa, Porcine reproductive and respiratory syndrome virus; identical to SEQ ID NO: 570

SEQ ID NO: 584 - protein, 34 aa, Porcine reproductive and respiratory syndrome virus; identical to SEQ ID NO: 502

SEQ ID NO: 585 - protein, 34 aa, Porcine reproductive and respiratory syndrome virus
PANADNSSSSHLQLIYNLTLCELNGTDWLANKFD

SEQ ID NO: 586 - protein, 34 aa, Porcine reproductive and respiratory syndrome virus
  misc_feature (7)..(7): Xaa can be any naturally occurring amino acid
LVNANSXSSSHFQLIYNLTLCELNGTDWLAGKFD

SEQ ID NO: 587 - protein, 34 aa, Porcine reproductive and respiratory syndrome virus; identical to SEQ ID NO: 177

SEQ ID NO: 588 - protein, 34 aa, Porcine reproductive and respiratory syndrome virus; identical to SEQ ID NO: 177

SEQ ID NO: 589 - protein, 34 aa, Porcine reproductive and respiratory syndrome virus
IVNASNTSSSHFQLIYNMTICELNGTDWLANKFD

SEQ ID NO: 590 - protein, 34 aa, Porcine reproductive and respiratory syndrome virus
LVNANSNSSSHLQLIYNLTLCELNGTDWLSDKFN

SEQ ID NO: 591 - protein, 34 aa, Porcine reproductive and respiratory syndrome virus
IVNASSNSSSHFQLIYNLTICELNGTDWLNKKFD

SEQ ID NO: 592 - protein, 34 aa, Porcine reproductive and respiratory syndrome virus; identical to SEQ ID NO: 64

SEQ ID NO: 593 - protein, 34 aa, Porcine reproductive and respiratory syndrome virus
IVNANSNSSSHFQLIYNLTLCELNGTEWLANKFD

SEQ ID NO: 594 - protein, 34 aa, Porcine reproductive and respiratory syndrome virus
LVNANSNNSSHFQLIYNLTICELNGTDWLNNKFD

SEQ ID NO: 595 - protein, 34 aa, Porcine reproductive and respiratory syndrome virus
LVNANSNSSSHFQLIYNLTLCELNGTDWLDKKFD

SEQ ID NO: 596 - protein, 34 aa, Porcine reproductive and respiratory syndrome virus
LVNASSNSSSHFQLIYNLTLCELNGTDWLAEKFD

SEQ ID NO: 597 - protein, 34 aa, Porcine reproductive and respiratory syndrome virus; identical to SEQ ID NO: 55

SEQ ID NO: 598 - protein, 34 aa, Porcine reproductive and respiratory syndrome virus
LANANSDSSSHLQLIYNLTLCELNGTDWLANKFD

SEQ ID NO: 599 - protein, 34 aa, Porcine reproductive and respiratory syndrome virus; identical to SEQ ID NO: 253

SEQ ID NO: 600 - protein, 34 aa, Porcine reproductive and respiratory syndrome virus
LVNAKSNSSSHLQLIYNLTLCELNGTDWLKNKFD

SEQ ID NO: 601 - protein, 34 aa, Porcine reproductive and respiratory syndrome virus
LVNANSNSSSHFQLIYNLTICELNGTDWLDEKFD

SEQ ID NO: 602 - protein, 34 aa, Porcine reproductive and respiratory syndrome virus
LVDASNNSSSHLQLIYNLTLCELNGTDWLANKFD

SEQ ID NO: 603 - protein, 34 aa, Porcine reproductive and respiratory syndrome virus; identical to SEQ ID NO: 177

SEQ ID NO: 604 - protein, 34 aa, Porcine reproductive and respiratory syndrome virus
LVNANSNSSSHLQLIYNLTLCELNGTDWLRNKFD

SEQ ID NO: 605 - protein, 34 aa, Porcine reproductive and respiratory syndrome virus
LVNANSNSSSHLQLIYNLTLCELNGTDWLNDRFD

SEQ ID NO: 606 - protein, 34 aa, Porcine reproductive and respiratory syndrome virus; identical to SEQ ID NO: 55

SEQ ID NO: 607 - protein, 34 aa, Porcine reproductive and respiratory syndrome virus; identical to SEQ ID NO: 47

SEQ ID NO: 608 - protein, 34 aa, Porcine reproductive and respiratory syndrome virus; identical to SEQ ID NO: 550

SEQ ID NO: 609 - protein, 34 aa, Porcine reproductive and respiratory syndrome virus
LVNANSQNSSHFQLIYNLTLCELNGTDWLVNKFD

SEQ ID NO: 610 - protein, 34 aa, Porcine reproductive and respiratory syndrome virus; identical to SEQ ID NO: 513

SEQ ID NO: 611 - protein, 34 aa, Porcine reproductive and respiratory syndrome virus; identical to SEQ ID NO: 41

SEQ ID NO: 612 - protein, 34 aa, Porcine reproductive and respiratory syndrome virus
LANASNNSSSHLQLIYNLTLCELNGTDWLADRFD

SEQ ID NO: 613 - protein, 34 aa, Porcine reproductive and respiratory syndrome virus; identical to SEQ ID NO: 353

SEQ ID NO: 614 - protein, 34 aa, Porcine reproductive and respiratory syndrome virus
  misc_feature (5)..(5): Xaa can be any naturally occurring amino acid
LANAXENSSSHLQLIYNLTLCELNGTDWLANKFD

SEQ ID NO: 615 - protein, 34 aa, Porcine reproductive and respiratory syndrome virus; identical to SEQ ID NO: 55

SEQ ID NO: 616 - protein, 34 aa, Porcine reproductive and respiratory syndrome virus; identical to SEQ ID NO: 55

SEQ ID NO: 617 - protein, 34 aa, Porcine reproductive and respiratory syndrome virus
LVNANSNSSSHFQLIYNLTLCELNGTDWLAKNFD

SEQ ID NO: 618 - protein, 34 aa, Porcine reproductive and respiratory syndrome virus; identical to SEQ ID NO: 593

SEQ ID NO: 619 - protein, 34 aa, Porcine reproductive and respiratory syndrome virus
LANANENSSSHLQLIYNLTLCELNGTDWLANKFD

SEQ ID NO: 620 - protein, 34 aa, Porcine reproductive and respiratory syndrome virus; identical to SEQ ID NO: 563

SEQ ID NO: 621 - protein, 34 aa, Porcine reproductive and respiratory syndrome virus
LVNANSNSSSHFQLIYNLTLCELNGTDWLSKKFD

SEQ ID NO: 622 - protein, 34 aa, Porcine reproductive and respiratory syndrome virus
LVNAGSNSSSHFQLIYNLTLCELNGTDWLKDKFD

SEQ ID NO: 623 - protein, 34 aa, Porcine reproductive and respiratory syndrome virus; identical to SEQ ID NO: 39

SEQ ID NO: 624 - protein, 34 aa, Porcine reproductive and respiratory syndrome virus; identical to SEQ ID NO: 229

SEQ ID NO: 625 - protein, 34 aa, Porcine reproductive and respiratory syndrome virus; identical to SEQ ID NO: 605

SEQ ID NO: 626 - protein, 34 aa, Porcine reproductive and respiratory syndrome virus
LVNANSTSSSHFQLIYNLTLCELNGTEWLANRFD

SEQ ID NO: 627 - protein, 34 aa, Porcine reproductive and respiratory syndrome virus
LVNANSNSSSHLQLIYNLTLCELNGTDWLAKRFD

SEQ ID NO: 628 - protein, 34 aa, Porcine reproductive and respiratory syndrome virus
LVNANSNSSSQLQLIYNLTLCELNGTDWLANKFD

SEQ ID NO: 629 - protein, 34 aa, Porcine reproductive and respiratory syndrome virus; identical to SEQ ID NO: 572

SEQ ID NO: 630 - protein, 34 aa, Porcine reproductive and respiratory syndrome virus; identical to SEQ ID NO: 486

SEQ ID NO: 631 - protein, 34 aa, Porcine reproductive and respiratory syndrome virus; identical to SEQ ID NO: 486

SEQ ID NO: 632 - protein, 34 aa, Porcine reproductive and respiratory syndrome virus; identical to SEQ ID NO: 486

SEQ ID NO: 633 - protein, 34 aa, Porcine reproductive and respiratory syndrome virus; identical to SEQ ID NO: 267

SEQ ID NO: 634 - protein, 34 aa, Porcine reproductive and respiratory syndrome virus
  misc_feature (7)..(7): Xaa can be any naturally occurring amino acid
  misc_feature (31)..(31): Xaa can be any naturally occurring amino acid
LVNANSXSSSHLQLIYNLTICELNGTDWLTXHFS

SEQ ID NO: 635 - protein, 34 aa, Porcine reproductive and respiratory syndrome virus; identical to SEQ ID NO: 486

SEQ ID NO: 636 - protein, 34 aa, Porcine reproductive and respiratory syndrome virus; identical to SEQ ID NO: 486

SEQ ID NO: 637 - protein, 34 aa, Porcine reproductive and respiratory syndrome virus; identical to SEQ ID NO: 227

SEQ ID NO: 638 - protein, 34 aa, Porcine reproductive and respiratory syndrome virus; identical to SEQ ID NO: 486

SEQ ID NO: 639 - protein, 34 aa, Porcine reproductive and respiratory syndrome virus; identical to SEQ ID NO: 55

SEQ ID NO: 640 - protein, 34 aa, Porcine reproductive and respiratory syndrome virus
  misc_feature (19)..(19): Xaa can be any naturally occurring amino acid
  misc_feature (22)..(22): Xaa can be any naturally occurring amino acid
  misc_feature (30)..(30): Xaa can be any naturally occurring amino acid
LVNADSNSSSHLQSIYNLXICXLNGTDWLXNHFS

SEQ ID NO: 641 - protein, 34 aa, Porcine reproductive and respiratory syndrome virus; identical to SEQ ID NO: 560

SEQ ID NO: 642 - protein, 34 aa, Porcine reproductive and respiratory syndrome virus
IVDANSNSSSHFQLIYNLTICELNGTDWLGEKFD

SEQ ID NO: 643 - protein, 34 aa, Porcine reproductive and respiratory syndrome virus
LVNASNNSSSHLQLIYNLTLCELNGTDWLADRFD

SEQ ID NO: 644 - protein, 34 aa, Porcine reproductive and respiratory syndrome virus
LVNASNDSSSHLQLIYNLTICELNGTDWLGKKFD

SEQ ID NO: 645 - protein, 34 aa, Porcine reproductive and respiratory syndrome virus
  misc_feature (27)..(27): Xaa can be any naturally occurring amino acid
LVNADSNSSSHLQLIYNLTICELNGTXWLNNHFS

SEQ ID NO: 646 - protein, 34 aa, Porcine reproductive and respiratory syndrome virus
LVNANSNSSSHFQLIYNLTLCELNGTDWLANNFD

SEQ ID NO: 647 - protein, 34 aa, Porcine reproductive and respiratory syndrome virus; identical to SEQ ID NO: 47

SEQ ID NO: 648 - protein, 34 aa, Porcine reproductive and respiratory syndrome virus
LVNADSNSSSHLQLIYNLTICELNGTDWLNDHFS

SEQ ID NO: 649 - protein, 34 aa, Porcine reproductive and respiratory syndrome virus
SFADGNGNNSTYQYIYNLTICELNGTKWLSGHFD

SEQ ID NO: 650 - protein, 34 aa, Porcine reproductive and respiratory syndrome virus
  misc_feature (31)..(31): Xaa can be any naturally occurring amino acid
IVNANSBSSSHIQLIYNLTLCELNGTDWLAXKFD

SEQ ID NO: 651 - protein, 34 aa, Porcine reproductive and respiratory syndrome virus; identical to SEQ ID NO: 563

SEQ ID NO: 652 - protein, 34 aa, Porcine reproductive and respiratory syndrome virus
LVNADSNRSSHFQSIYNLTLCELNGTDWLAGKFD

SEQ ID NO: 653 - protein, 34 aa, Porcine reproductive and respiratory syndrome virus; identical to SEQ ID NO: 567

SEQ ID NO: 654 - protein, 34 aa, Porcine reproductive and respiratory syndrome virus
LVNANSNSSSHFQLIYNLTLCELNGTDWLKDKFD

SEQ ID NO: 655 - protein, 34 aa, Porcine reproductive and respiratory syndrome virus
LVNANSNSSSHLQLIYNLTLCELNGTDWLANKFD

SEQ ID NO: 656 - protein, 34 aa, Porcine reproductive and respiratory syndrome virus
LVDANSNSSSHFQLIYNLTLCELNGTDWLNNKFD

SEQ ID NO: 657 - protein, 34 aa, Porcine reproductive and respiratory syndrome virus; identical to SEQ ID NO: 267

SEQ ID NO: 658 - protein, 34 aa, Porcine reproductive and respiratory syndrome virus
IVNASGNSSSHFQLIYNLTLCELNGTEWLANKFD

SEQ ID NO: 659 - protein, 34 aa, Porcine reproductive and respiratory syndrome virus
LANASNNSSSHLQLIYNLTLCELNGTDWLAGKFD

SEQ ID NO: 660 - protein, 34 aa, Porcine reproductive and respiratory syndrome virus; identical to SEQ ID NO: 484

SEQ ID NO: 661 - protein, 34 aa, Porcine reproductive and respiratory syndrome virus; identical to SEQ ID NO: 486

SEQ ID NO: 662 - protein, 34 aa, Porcine reproductive and respiratory syndrome virus; identical to SEQ ID NO: 267

SEQ ID NO: 663 - protein, 34 aa, Porcine reproductive and respiratory syndrome virus
LVNANSNSSSHLQLIYNLTICELNGTEWLNNHFS

SEQ ID NO: 664 - protein, 34 aa, Porcine reproductive and respiratory syndrome virus; identical to SEQ ID NO: 456

SEQ ID NO: 665 - protein, 34 aa, Porcine reproductive and respiratory syndrome virus
LVNAGSNNSSHLQLIYNLTICELNGTDWLNNHFS

SEQ ID NO: 666 - protein, 34 aa, Porcine reproductive and respiratory syndrome virus
LVNASNNSSSHLQLIYNMTVCELNGTDWLKNKFD

SEQ ID NO: 667 - protein, 34 aa, Porcine reproductive and respiratory syndrome virus
LVNASNDSSSHLQLIYNLTLCELNGTDWLADKFD

SEQ ID NO: 668 - protein, 34 aa, Porcine reproductive and respiratory syndrome virus; identical to SEQ ID NO: 360

SEQ ID NO: 669 - protein, 34 aa, Porcine reproductive and respiratory syndrome virus; identical to SEQ ID NO: 41

SEQ ID NO: 670 - protein, 34 aa, Porcine reproductive and respiratory syndrome virus; identical to SEQ ID NO: 572

SEQ ID NO: 671 - protein, 34 aa, Porcine reproductive and respiratory syndrome virus; identical to SEQ ID NO: 572

SEQ ID NO: 672 - protein, 34 aa, Porcine reproductive and respiratory syndrome virus; identical to SEQ ID NO: 564

SEQ ID NO: 673 - protein, 34 aa, Porcine reproductive and respiratory syndrome virus
LVDANSNSSSHFQLIYNLTLCELNGTDWLAKKFD

SEQ ID NO: 674 - protein, 34 aa, Porcine reproductive and respiratory syndrome virus
LVNASSNSSSHFQLIYNLTLCELNGTDWLATKFD

SEQ ID NO: 675 - protein, 34 aa, Porcine reproductive and respiratory syndrome virus
LVNANSSSSSHLQLIYNLTICELNGTDWLNNHFS

SEQ ID NO: 676 - protein, 34 aa, Porcine reproductive and respiratory syndrome virus
LVNANSNSSSHFQLIYNLTICELNGTDWLKERFD

SEQ ID NO: 677 - protein, 34 aa, Porcine reproductive and respiratory syndrome virus
LVNASGNSSSHLQLIYNLTLCELNGTDWLADKFD

SEQ ID NO: 678 - protein, 34 aa, Porcine reproductive and respiratory syndrome virus; identical to SEQ ID NO: 571

SEQ ID NO: 679 - protein, 33 aa, Porcine reproductive and respiratory syndrome virus
LVNASDSSSHLQLIYNLTICELNGTDWLNNHFS

SEQ ID NO: 680 - protein, 34 aa, Porcine reproductive and respiratory syndrome virus
LVNASSNSSSHLQLIYNLTICELNGTDWLNNHFS

SEQ ID NO: 681 - protein, 34 aa, Porcine reproductive and respiratory syndrome virus
LVDANSNSSSHLQLIYNLTLCELNGTDWLADKFD

SEQ ID NO: 682 - protein, 34 aa, Porcine reproductive and respiratory syndrome virus; identical to SEQ ID NO: 360

SEQ ID NO: 683 - protein, 34 aa, Porcine reproductive and respiratory syndrome virus; identical to SEQ ID NO: 75

SEQ ID NO: 684 - protein, 34 aa, Porcine reproductive and respiratory syndrome virus; identical to SEQ ID NO: 680

SEQ ID NO: 685 - protein, 34 aa, Porcine reproductive and respiratory syndrome virus
LVNANSNSSSHFQLIYNLTLCELNGTEWLGKKFD

SEQ ID NO: 686 - protein, 34 aa, Porcine reproductive and respiratory syndrome virus
LVNANSNSSSHFQLIYNLTLCELNGTDWLAGKFD

SEQ ID NO: 687 - protein, 34 aa, Porcine reproductive and respiratory syndrome virus; identical to SEQ ID NO: 617

SEQ ID NO: 688 - protein, 34 aa, Porcine reproductive and respiratory syndrome virus; identical to SEQ ID NO: 542

SEQ ID NO: 689 - protein, 34 aa, Porcine reproductive and respiratory syndrome virus; identical to SEQ ID NO: 572

SEQ ID NO: 690 - protein, 34 aa, Porcine reproductive and respiratory syndrome virus
LVNANSNSSSHFQLIYNLTLCELNGTDWLGKKFD

SEQ ID NO: 691 - protein, 34 aa, Porcine reproductive and respiratory syndrome virus
LVDANSNSSSHFQLIYNLTICELNGTDWLEKKFD

SEQ ID NO: 692 - protein, 34 aa, Porcine reproductive and respiratory syndrome virus; identical to SEQ ID NO: 172

SEQ ID NO: 693 - protein, 34 aa, Porcine reproductive and respiratory syndrome virus
LVNANSNHSSHFQLIYNLTLCELNGTEWLANKFD

SEQ ID NO: 694 - protein, 34 aa, Porcine reproductive and respiratory syndrome virus
LVNAGSNSSSHLQLIYNLTICELNGTDWLNNHFS

SEQ ID NO: 695 - protein, 34 aa, Porcine reproductive and respiratory syndrome virus
  misc_feature (31)..(31): Xaa can be any naturally occurring amino acid
LANANSNSSSHLQLIYNLTLCELNGTDWLAXKFD

SEQ ID NO: 696 - protein, 34 aa, Porcine reproductive and respiratory syndrome virus
LVNASGNSSSHLQLIYNLTICELNGTDWLNNTFD

SEQ ID NO: 697 - protein, 34 aa, Porcine reproductive and respiratory syndrome virus; identical to SEQ ID NO: 486

SEQ ID NO: 698 - protein, 34 aa, Porcine reproductive and respiratory syndrome virus; identical to SEQ ID NO: 596

SEQ ID NO: 699 - protein, 34 aa, Porcine reproductive and respiratory syndrome virus
IVNANGNSSSHFQLIYNLTLCELNGTEWLANKFD

SEQ ID NO: 700 - protein, 34 aa, Porcine reproductive and respiratory syndrome virus
LVNASSNSSSHFQLIYNLTLCELNGTEWLADKFD

SEQ ID NO: 701 - protein, 34 aa, Porcine reproductive and respiratory syndrome virus; identical to SEQ ID NO: 574

SEQ ID NO: 702 - protein, 34 aa, Porcine reproductive and respiratory syndrome virus
PVNANKTDSSKLQLIYNLTLCELNGTDWLANKFD

SEQ ID NO: 703 - protein, 34 aa, Porcine reproductive and respiratory syndrome virus
LVNANGNSSSHFQLIYNLTLCELNGTDWLGKKFD

SEQ ID NO: 704 - protein, 34 aa, Porcine reproductive and respiratory syndrome virus
LVSANSNSSSHFQLIYNLTLCELNGTDWLAKKFD

SEQ ID NO: 705 - protein, 34 aa, Porcine reproductive and respiratory syndrome virus
  misc_feature (7)..(7): Xaa can be any naturally occurring amino acid
LVNANSXSSSHLQLIYNLTLCELNGTDWLKNKFD

SEQ ID NO: 706 - protein, 34 aa, Porcine reproductive and respiratory syndrome virus
LVNANSNSSSHLQLIYNLTICELNGTEWLDNHFS

SEQ ID NO: 707 - protein, 34 aa, Porcine reproductive and respiratory syndrome virus; identical to SEQ ID NO: 267

SEQ ID NO: 708 - protein, 34 aa, Porcine reproductive and respiratory syndrome virus
  misc_feature (31)..(31): Xaa can be any naturally occurring amino acid
LVNANSNSSSHFQLIYNLTLCELNGTDWLAXKFD

SEQ ID NO: 709 - protein, 34 aa, Porcine reproductive and respiratory syndrome virus; identical to SEQ ID NO: 708
  misc_feature (31)..(31): Xaa can be any naturally occurring amino acid

SEQ ID NO: 710 - protein, 34 aa, Porcine reproductive and respiratory syndrome virus; identical to SEQ ID NO: 484

SEQ ID NO: 711 - protein, 34 aa, Porcine reproductive and respiratory syndrome virus; identical to SEQ ID NO: 680

SEQ ID NO: 712 - protein, 34 aa, Porcine reproductive and respiratory syndrome virus; identical to SEQ ID NO: 267

SEQ ID NO: 713 - protein, 34 aa, Porcine reproductive and respiratory syndrome virus
LVNANSNSSSHIQLIYNLTLCELNGTEWLSGKFD

SEQ ID NO: 714 - protein, 34 aa, Porcine reproductive and respiratory syndrome virus
LVNANNDSSSHMQLIYNLTICELNGTDWLANHFG

SEQ ID NO: 715 - protein, 34 aa, Porcine reproductive and respiratory syndrome virus
IVNANSSSSSHIQLIYNLTLCELNGTDWLADKFD

SEQ ID NO: 716 - protein, 34 aa, Porcine reproductive and respiratory syndrome virus; identical to SEQ ID NO: 486

SEQ ID NO: 717 - protein, 34 aa, Porcine reproductive and respiratory syndrome virus
LVNASGNSSSHLQLIYNLTICELNGTDWLNDKFD

SEQ ID NO: 718 - protein, 34 aa, Porcine reproductive and respiratory syndrome virus; identical to SEQ ID NO: 690

SEQ ID NO: 719 - protein, 34 aa, Porcine reproductive and respiratory syndrome virus; identical to SEQ ID NO: 499

SEQ ID NO: 720 - protein, 34 aa, Porcine reproductive and respiratory syndrome virus
LVNANSNSSSHLQSIYNLTICELNGTDWLNNHFS

SEQ ID NO: 721 - protein, 34 aa, Porcine reproductive and respiratory syndrome virus
LVNASNNSSSHLQLIYNLTICELNGTDWLGNTFN

SEQ ID NO: 722 - protein, 34 aa, Porcine reproductive and respiratory syndrome virus; identical to SEQ ID NO: 696

SEQ ID NO: 723 - protein, 34 aa, Porcine reproductive and respiratory syndrome virus
  misc_feature (19)..(19): Xaa can be any naturally occurring amino acid
  misc_feature (30)..(30): Xaa can be any naturally occurring amino acid
LVNADSNSSSHLQLIYNLXICELNGTDWLXNHFS

SEQ ID NO: 724 - protein, 34 aa, Porcine reproductive and respiratory syndrome virus; identical to SEQ ID NO: 546

SEQ ID NO: 725 - protein, 34 aa, Porcine reproductive and respiratory syndrome virus; identical to SEQ ID NO: 486

SEQ ID NO: 726 - protein, 34 aa, Porcine reproductive and respiratory syndrome virus; identical to SEQ ID NO: 572

SEQ ID NO: 727 - protein, 34 aa, Porcine reproductive and respiratory syndrome virus; identical to SEQ ID NO: 267

SEQ ID NO: 728 - protein, 34 aa, Porcine reproductive and respiratory syndrome virus
LVNANNTSSSHLQLIYNLTLCELNGTDWLANKFD

SEQ ID NO: 729 - protein, 34 aa, Porcine reproductive and respiratory syndrome virus; identical to SEQ ID NO: 690

SEQ ID NO: 730 - protein, 34 aa, Porcine reproductive and respiratory syndrome virus; identical to SEQ ID NO: 546

SEQ ID NO: 731 - protein, 34 aa, Porcine reproductive and respiratory syndrome virus; identical to SEQ ID NO: 47

SEQ ID NO: 732 - protein, 34 aa, Porcine reproductive and respiratory syndrome virus; identical to SEQ ID NO: 267

SEQ ID NO: 733 - protein, 34 aa, Porcine reproductive and respiratory syndrome virus; identical to SEQ ID NO: 680

SEQ ID NO: 734 - protein, 34 aa, Porcine reproductive and respiratory syndrome virus
LVNANSNSSSHLQLIYNLTICELNGTDWLNNTFD

SEQ ID NO: 735 - protein, 34 aa, Porcine reproductive and respiratory syndrome virus; identical to SEQ ID NO: 696

SEQ ID NO: 736 - protein, 34 aa, Porcine reproductive and respiratory syndrome virus; identical to SEQ ID NO: 93

SEQ ID NO: 737 - protein, 34 aa, Porcine reproductive and respiratory syndrome virus
LVNASNSSSSHLQLIYNLTLCELNGTDWLADKFD

SEQ ID NO: 738 - protein, 34 aa, Porcine reproductive and respiratory syndrome virus; identical to SEQ ID NO: 61

SEQ ID NO: 739 - protein, 34 aa, Porcine reproductive and respiratory syndrome virus
FVNANSNSSSHFQLIYNLTLCELNGTDWLNNKFD

SEQ ID NO: 740 - protein, 34 aa, Porcine reproductive and respiratory syndrome virus
LVNAHSNSSSHLQLIYNLTICELNGTDWLNRHFS

SEQ ID NO: 741 - protein, 34 aa, Porcine reproductive and respiratory syndrome virus
LVNASSNSSSHLQLIYNLTICELNGTDWLNNRFS

SEQ ID NO: 742 - protein, 34 aa, Porcine reproductive and respiratory syndrome virus; identical to SEQ ID NO: 48

SEQ ID NO: 743 - protein, 34 aa, Porcine reproductive and respiratory syndrome virus
LVDANSNSSSHFQLIYNLTICELNGTDWLKEKFD

SEQ ID NO: 744 - protein, 34 aa, Porcine reproductive and respiratory syndrome virus; identical to SEQ ID NO: 680

SEQ ID NO: 745 - protein, 34 aa, Porcine reproductive and respiratory syndrome virus
LVNASSNSSSHLQLIYNMTVCELNGTDWLKTKFD

SEQ ID NO: 746 - protein, 34 aa, Porcine reproductive and respiratory syndrome virus
IVNADSNSSSHFQLIYNLTLCELNGTDWLAKKFD

SEQ ID NO: 747 - protein, 34 aa, Porcine reproductive and respiratory syndrome virus; identical to SEQ ID NO: 350

SEQ ID NO: 748 - protein, 34 aa, Porcine reproductive and respiratory syndrome virus; identical to SEQ ID NO: 572

SEQ ID NO: 749 - protein, 34 aa, Porcine reproductive and respiratory syndrome virus; identical to SEQ ID NO: 178

SEQ ID NO: 750 - protein, 34 aa, Porcine reproductive and respiratory syndrome virus
  misc_feature (19)..(19): Xaa can be any naturally occurring amino acid
LVNADSNSSSHLQLIYNLXICELNGTDWLNNHFS

SEQ ID NO: 751 - protein, 34 aa, Porcine reproductive and respiratory syndrome virus
  misc_feature (30)..(30): Xaa can be any naturally occurring amino acid
LVNANSNSSSHLQSIYNLTICELNGTDWLXNHFS

SEQ ID NO: 752 - protein, 34 aa, Porcine reproductive and respiratory syndrome virus; identical to SEQ ID NO: 256

SEQ ID NO: 753 - protein, 34 aa, Porcine reproductive and respiratory syndrome virus; identical to SEQ ID NO: 267

SEQ ID NO: 754 - protein, 34 aa, Porcine reproductive and respiratory syndrome virus
LVNANSNSSSHLQLIYNLTLCELNGTDWLAGKFS

SEQ ID NO: 755 - protein, 34 aa, Porcine reproductive and respiratory syndrome virus
IVNASSNSSSHFQLIYNLTICELNGTDWLNQKFD

SEQ ID NO: 756 - protein, 34 aa, Porcine reproductive and respiratory syndrome virus
LVNASNSNSSHLQLIYNLTLCELNGTDWLANKFD

SEQ ID NO: 757 - protein, 34 aa, Porcine reproductive and respiratory syndrome virus; identical to SEQ ID NO: 737

SEQ ID NO: 758 - protein, 34 aa, Porcine reproductive and respiratory syndrome virus
LVNANSNSSSHFQLIYNLTLCELNGTDWLDKHFY

SEQ ID NO: 759 - protein, 34 aa, Porcine reproductive and respiratory syndrome virus
LVNASNSSSSHLQLIYNLTICELNGTDWLNNKFD

SEQ ID NO: 760 - protein, 34 aa, Porcine reproductive and respiratory syndrome virus
LANASDNNSSHLQLIYNLTLCELNGTDWLANKFD

SEQ ID NO: 761 - protein, 34 aa, Porcine reproductive and respiratory syndrome virus; identical to SEQ ID NO: 267

SEQ ID NO: 762 - protein, 34 aa, Porcine reproductive and respiratory syndrome virus
LVNASNNGSSHLQLIYNLTLCELNGTDWLANKFD

SEQ ID NO: 763 - protein, 34 aa, Porcine reproductive and respiratory syndrome virus; identical to SEQ ID NO: 486

SEQ ID NO: 764 - protein, 34 aa, Porcine reproductive and respiratory syndrome virus; identical to SEQ ID NO: 717

SEQ ID NO: 765 - protein, 34 aa, Porcine reproductive and respiratory syndrome virus
LANASNNNSSHLQLIYNLTLCELNGTDWLANKFD

SEQ ID NO: 766 - protein, 34 aa, Porcine reproductive and respiratory syndrome virus; identical to SEQ ID NO: 765

SEQ ID NO: 767 - protein, 34 aa, Porcine reproductive and respiratory syndrome virus
LVNANNSSSSHFQLIYNLTLCELNGTDWIANHFS

SEQ ID NO: 768 - protein, 34 aa, Porcine reproductive and respiratory syndrome virus
LVNANSNSSSHLQLIYNLTICELNGTDWLNEHFS

SEQ ID NO: 769 - protein, 34 aa, Porcine reproductive and respiratory syndrome virus
LVNASNNSSSHLQLIYNLTICELNGTDWLGNKFD

SEQ ID NO: 770 - protein, 34 aa, Porcine reproductive and respiratory syndrome virus; identical to SEQ ID NO: 486

SEQ ID NO: 771 - protein, 34 aa, Porcine reproductive and respiratory syndrome virus; identical to SEQ ID NO: 463

SEQ ID NO: 772 - protein, 34 aa, Porcine reproductive and respiratory syndrome virus
LVNANSNSSSHLQLIYNLTICELNGTEWLDNRFS

SEQ ID NO: 773 - protein, 34 aa, Porcine reproductive and respiratory syndrome virus; identical to SEQ ID NO: 680

SEQ ID NO: 774 - protein, 34 aa, Porcine reproductive and respiratory syndrome virus; identical to SEQ ID NO: 483

SEQ ID NO: 775 - protein, 34 aa, Porcine reproductive and respiratory syndrome virus; identical to SEQ ID NO: 686

SEQ ID NO: 776 - protein, 34 aa, Porcine reproductive and respiratory syndrome virus; identical to SEQ ID NO: 483

SEQ ID NO: 777 - protein, 34 aa, Porcine reproductive and respiratory syndrome virus
LVNANSNSSSHFQSIYNLTLCELNGTDWLANKFD

SEQ ID NO: 778 - protein, 34 aa, Porcine reproductive and respiratory syndrome virus
  misc_feature (19)..(19): Xaa can be any naturally occurring amino acid
LVNANSNSSSHLQLIYNLXICELNGTDWLNNHFS

SEQ ID NO: 779 - protein, 34 aa, Porcine reproductive and respiratory syndrome virus; identical to SEQ ID NO: 778
  misc_feature (19)..(19): Xaa can be any naturally occurring amino acid

SEQ ID NO: 780 - protein, 34 aa, Porcine reproductive and respiratory syndrome virus; identical to SEQ ID NO: 267

SEQ ID NO: 781 - protein, 34 aa, Porcine reproductive and respiratory syndrome virus
IVNANSNSSSHFQLIYNLTICELNGTDWLNQKFD

SEQ ID NO: 782 - protein, 34 aa, Porcine reproductive and respiratory syndrome virus; identical to SEQ ID NO: 499

SEQ ID NO: 783 - protein, 34 aa, Porcine reproductive and respiratory syndrome virus; identical to SEQ ID NO: 267

SEQ ID NO: 784 - protein, 34 aa, Porcine reproductive and respiratory syndrome virus; identical to SEQ ID NO: 486

SEQ ID NO: 785 - protein, 34 aa, Porcine reproductive and respiratory syndrome virus
LANANNTSSSHLQLIYNLTLCELNGTDWLANKFD

SEQ ID NO: 786 - protein, 34 aa, Porcine reproductive and respiratory syndrome virus
LVNANSNSSSHFQLIYNLTLCELNGTDWLQGKFD

SEQ ID NO: 787 - protein, 34 aa, Porcine reproductive and respiratory syndrome virus; identical to SEQ ID NO: 486

SEQ ID NO: 788 - protein, 34 aa, Porcine reproductive and respiratory syndrome virus
LVNANSSSSSHFQLIYNLTLCELNGTDWLANHFD

SEQ ID NO: 789 - protein, 34 aa, Porcine reproductive and respiratory syndrome virus; identical to SEQ ID NO: 486

SEQ ID NO: 790 - protein, 34 aa, Porcine reproductive and respiratory syndrome virus
LANASTNSSSHLQLIYNLTLCELNGTDWLANKFD

SEQ ID NO: 791 - protein, 34 aa, Porcine reproductive and respiratory syndrome virus; identical to SEQ ID NO: 47

SEQ ID NO: 792 - protein, 34 aa, Porcine reproductive and respiratory syndrome virus
  misc_feature (5)..(5): Xaa can be any naturally occurring amino acid
LVNAXSNNSSHLQLIYNLTICELNGTDWLNNHFS

SEQ ID NO: 793 - protein, 34 aa, Porcine reproductive and respiratory syndrome virus; identical to SEQ ID NO: 483

SEQ ID NO: 794 - protein, 34 aa, Porcine reproductive and respiratory syndrome virus; identical to SEQ ID NO: 560

SEQ ID NO: 795 - protein, 34 aa, Porcine reproductive and respiratory syndrome virus
LVNASSNSSSHLQLIYNLTICELNGTDWLNNHFG

SEQ ID NO: 796 - protein, 34 aa, Porcine reproductive and respiratory syndrome virus
  misc_feature (22)..(22): Xaa can be any naturally occurring amino acid
  misc_feature (32)..(32): Xaa can be any naturally occurring amino acid
LVNANSNSSSHLQLIYNLTICXLNGTNWLNNXFS

SEQ ID NO: 797 - protein, 34 aa, Porcine reproductive and respiratory syndrome virus
  misc_feature (19)..(19): Xaa can be any naturally occurring amino acid
LVNASSNSSSHLQLIYSLXICELNGTDWLNNHFG

SEQ ID NO: 798 - protein, 34 aa, Porcine reproductive and respiratory syndrome virus
LVNAHSNSSSHLQLIYNLTICELNGTDWLNNRFS

SEQ ID NO: 799 - protein, 34 aa, Porcine reproductive and respiratory syndrome virus
LVNANSNSSSHFQLIYNLTLCELNGTDWLAKKFN

SEQ ID NO: 800 - protein, 34 aa, Porcine reproductive and respiratory syndrome virus; identical to SEQ ID NO: 188

SEQ ID NO: 801 - protein, 34 aa, Porcine reproductive and respiratory syndrome virus; identical to SEQ ID NO: 267

SEQ ID NO: 802 - protein, 34 aa, Porcine reproductive and respiratory syndrome virus
LANASGNSSSHLQLIYNLTLCELNGTDWLANKFD

SEQ ID NO: 803 - protein, 34 aa, Porcine reproductive and respiratory syndrome virus
LVNANSNSSSHLQLIYNLTICELNGTEWLNNQFS

SEQ ID NO: 804 - protein, 34 aa, Porcine reproductive and respiratory syndrome virus
LVDANSNSSSHFQLIYNLTLCELNGTDWLNNHFT

SEQ ID NO: 805 - protein, 34 aa, Porcine reproductive and respiratory syndrome virus
LVNANGNSSSHFQLIYNLTLCELNGTDWLENKFD

SEQ ID NO: 806 - protein, 34 aa, Porcine reproductive and respiratory syndrome virus
LANADSNSSSHLQLIYNLTLCELNGTDWLADKFD

SEQ ID NO: 807 - protein, 34 aa, Porcine reproductive and respiratory syndrome virus; identical to SEQ ID NO: 55

SEQ ID NO: 808 - protein, 34 aa, Porcine reproductive and respiratory syndrome virus
LVSANSNSSSHLQLIYNLTICELNGTDWLNNHFS

SEQ ID NO: 809 - protein, 34 aa, Porcine reproductive and respiratory syndrome virus; identical to SEQ ID NO: 696

SEQ ID NO: 810 - protein, 34 aa, Porcine reproductive and respiratory syndrome virus; identical to SEQ ID NO: 47

SEQ ID NO: 811 - protein, 34 aa, Porcine reproductive and respiratory syndrome virus
LVNANSNSSSHLQLIYNLTICELNGTDWLKDHFS

SEQ ID NO: 812 - protein, 34 aa, Porcine reproductive and respiratory syndrome virus
LVNAGSNSSSHLQLIYNLTICELNGTDWLKDHFN

SEQ ID NO: 813 - protein, 34 aa, Porcine reproductive and respiratory syndrome virus
LVNANSNNSSHLQLIYNLTICELNGTDWLBRHFG

SEQ ID NO: 814 - protein, 34 aa, Porcine reproductive and respiratory syndrome virus
LVNASNSSSSHFQLIYNLTLCELNGTDWLANKFD

SEQ ID NO: 815 - protein, 34 aa, Porcine reproductive and respiratory syndrome virus; identical to SEQ ID NO: 456

SEQ ID NO: 816 - protein, 34 aa, Porcine reproductive and respiratory syndrome virus
LVNADSNNSSHLQLIYNLTICELNGTDWLNKNFS

SEQ ID NO: 817 - protein, 34 aa, Porcine reproductive and respiratory syndrome virus; identical to SEQ ID NO: 786

SEQ ID NO: 818 - protein, 34 aa, Porcine reproductive and respiratory syndrome virus; identical to SEQ ID NO: 267

SEQ ID NO: 819 - protein, 34 aa, Porcine reproductive and respiratory syndrome virus
LVNAGSNSSSHLQLIYNLTICELNGTDWLNDHFS

SEQ ID NO: 820 - protein, 34 aa, Porcine reproductive and respiratory syndrome virus
LVNADNSSSSYSQLIYNLTLCELNGTDWLANKFD

SEQ ID NO: 821 - protein, 34 aa, Porcine reproductive and respiratory syndrome virus; identical to SEQ ID NO: 75

SEQ ID NO: 822 - protein, 34 aa, Porcine reproductive and respiratory syndrome virus
LVDANSNSSSHLQLIYNLTLCELNGTDWLNNKFD

SEQ ID NO: 823 - protein, 34 aa, Porcine reproductive and respiratory syndrome virus; identical to SEQ ID NO: 47

SEQ ID NO: 824 - protein, 34 aa, Porcine reproductive and respiratory syndrome virus; identical to SEQ ID NO: 486

SEQ ID NO: 825 - protein, 34 aa, Porcine reproductive and respiratory syndrome virus; identical to SEQ ID NO: 680

SEQ ID NO: 826 - protein, 34 aa, Porcine reproductive and respiratory syndrome virus; identical to SEQ ID NO: 267

SEQ ID NO: 827 - protein, 34 aa, Porcine reproductive and respiratory syndrome virus
LVNANSSSSSHIQLIYNLTLCELNGTDWLANKFD

SEQ ID NO: 828 - protein, 34 aa, Porcine reproductive and respiratory syndrome virus; identical to SEQ ID NO: 720

SEQ ID NO: 829 - protein, 34 aa, Porcine reproductive and respiratory syndrome virus; identical to SEQ ID NO: 267

SEQ ID NO: 830 - protein, 34 aa, Porcine reproductive and respiratory syndrome virus
LVNANSNSSSHFQLIYNLTICELNGTDWLNNHFS

SEQ ID NO: 831 - protein, 34 aa, Porcine reproductive and respiratory syndrome virus
IVNADSNSSSHLQLIYNLTICELNGTDWLNKKFD

SEQ ID NO: 832 - protein, 34 aa, Porcine reproductive and respiratory syndrome virus; identical to SEQ ID NO: 267

SEQ ID NO: 833 - protein, 34 aa, Porcine reproductive and respiratory syndrome virus; identical to SEQ ID NO: 656

SEQ ID NO: 834 - protein, 34 aa, Porcine reproductive and respiratory syndrome virus
  misc_feature (32)..(32): Xaa can be any naturally occurring amino acid
LVNADSNSSSHLQLIYNLTICELNGTDWLKNXFS

SEQ ID NO: 835 - protein, 34 aa, Porcine reproductive and respiratory syndrome virus
  misc_feature (31)..(31): Xaa can be any naturally occurring amino acid
LVNANSSSSSHIQLIYNLTLCELNGTDWLAXKFD

SEQ ID NO: 836 - protein, 34 aa, Porcine reproductive and respiratory syndrome virus; identical to SEQ ID NO: 798

SEQ ID NO: 837 - protein, 34 aa, Porcine reproductive and respiratory syndrome virus
LVNADSNSSSHLQLIYNLTICELNGTDWLNNHFG

SEQ ID NO: 838 - protein, 34 aa, Porcine reproductive and respiratory syndrome virus; identical to SEQ ID NO: 75

SEQ ID NO: 839 - protein, 34 aa, Porcine reproductive and respiratory syndrome virus
LVNANNDSSSHLQLIYNLTICELNGTDWLNDHFS

SEQ ID NO: 840 - protein, 33 aa, Porcine reproductive and respiratory syndrome virus
VNANSNSSSHFQLIYNLTLCELNGTDWLASHFN

SEQ ID NO: 841 - protein, 34 aa, Porcine reproductive and respiratory syndrome virus; identical to SEQ ID NO: 267

SEQ ID NO: 842 - protein, 34 aa, Porcine reproductive and respiratory syndrome virus
LVNADSNNSSHLQLIYNLTICELNGTDWLNKNFG

SEQ ID NO: 843 - protein, 34 aa, Porcine reproductive and respiratory syndrome virus
LVNASSNSSSHLQLIYNLTICELNGTDWLNNKFD

SEQ ID NO: 844 - protein, 34 aa, Porcine reproductive and respiratory syndrome virus; identical to SEQ ID NO: 598

SEQ ID NO: 845 - protein, 34 aa, Porcine reproductive and respiratory syndrome virus; identical to SEQ ID NO: 798

SEQ ID NO: 846 - protein, 34 aa, Porcine reproductive and respiratory syndrome virus
LANANSNSSSHLQLIYNLTLCELNGTDWLABKFD

SEQ ID NO: 847 - protein, 34 aa, Porcine reproductive and respiratory syndrome virus; identical to SEQ ID NO: 47

SEQ ID NO: 848 - protein, 34 aa, Porcine reproductive and respiratory syndrome virus
IVNANSNSSSHIQLIYNLTLCELNGTDWLANKFD

SEQ ID NO: 849 - protein, 34 aa, Porcine reproductive and respiratory syndrome virus
LVNASSNSSSHLQLIYNLTICELNGTDWLGNEFD

SEQ ID NO: 850 - protein, 34 aa, Porcine reproductive and respiratory syndrome virus
LVNASSNSSSHLQLIYNLTLCELNGTDWLADRFD

SEQ ID NO: 851 - protein, 34 aa, Porcine reproductive and respiratory syndrome virus; identical to SEQ ID NO: 188

SEQ ID NO: 852 - protein, 34 aa, Porcine reproductive and respiratory syndrome virus; identical to SEQ ID NO: 75

SEQ ID NO: 853 - protein, 34 aa, Porcine reproductive and respiratory syndrome virus
LVNASSNSSSHFQLIYNLTLCELNGTDWLAEHFD

SEQ ID NO: 854 - protein, 34 aa, Porcine reproductive and respiratory syndrome virus; identical to SEQ ID NO: 696

SEQ ID NO: 855 - protein, 34 aa, Porcine reproductive and respiratory syndrome virus
LVNANSNSSSHFQLIYNLTICELNGTDWLDQKFD

SEQ ID NO: 856 - protein, 34 aa, Porcine reproductive and respiratory syndrome virus
LVNADSNSSSHLQLIYNLPICELNGTDWLNNHFS

SEQ ID NO: 857 - protein, 34 aa, Porcine reproductive and respiratory syndrome virus; identical to SEQ ID NO: 717

SEQ ID NO: 858 - protein, 34 aa, Porcine reproductive and respiratory syndrome virus
LVNANNSSSSHFQLIYNLTLCELNGTDWLANKFD

SEQ ID NO: 859 - protein, 34 aa, Porcine reproductive and respiratory syndrome virus
PVNANTNNSSKLQLIYNLTLCELNGTDWLADRFN

SEQ ID NO: 860 - protein, 34 aa, Porcine reproductive and respiratory syndrome virus
LVNANNSSSSHLQLIYNLTLCELNGTDWLADKFD

SEQ ID NO: 861 - protein, 34 aa, Porcine reproductive and respiratory syndrome virus
LVNANSSSSSHIQLIYNLTLCELNGTDWLADRFD

SEQ ID NO: 862 - protein, 34 aa, Porcine reproductive and respiratory syndrome virus
LVNANSNSSSHLQLIYNLTLCELNGTDWLRDKFD

SEQ ID NO: 863 - protein, 34 aa, Porcine reproductive and respiratory syndrome virus; identical to SEQ ID NO: 713

SEQ ID NO: 864 - protein, 34 aa, Porcine reproductive and respiratory syndrome virus; identical to SEQ ID NO: 47

SEQ ID NO: 865 - protein, 34 aa, Porcine reproductive and respiratory syndrome virus; identical to SEQ ID NO: 267

SEQ ID NO: 866 - protein, 34 aa, Porcine reproductive and respiratory syndrome virus
IVNASSNSSSHIQLIYNLTLCELNGTDWLADKFD

SEQ ID NO: 867 - protein, 34 aa, Porcine reproductive and respiratory syndrome virus
LVNANSNSSSHLQLIYNLTICELNGTDWLNNKFD

SEQ ID NO: 868 - protein, 34 aa, Porcine reproductive and respiratory syndrome virus
FVSASANSSSHLQLIYNLTICELNGTDWLNEHFG

SEQ ID NO: 869 - protein, 34 aa, Porcine reproductive and respiratory syndrome virus; identical to SEQ ID NO: 75

SEQ ID NO: 870 - protein, 34 aa, Porcine reproductive and respiratory syndrome virus
LDNADSNSSSHLQLIYNLTICELNGTDWLNNHFS

SEQ ID NO: 871 - protein, 34 aa, Porcine reproductive and respiratory syndrome virus; identical to SEQ ID NO: 236

SEQ ID NO: 872 - protein, 34 aa, Porcine reproductive and respiratory syndrome virus; identical to SEQ ID NO: 484

SEQ ID NO: 873 - protein, 34 aa, Porcine reproductive and respiratory syndrome virus
LVNASNNSSSHLQLIYNLTICELNGTDWLBNTFD

SEQ ID NO: 874 - protein, 34 aa, Porcine reproductive and respiratory syndrome virus
LVNASGNSSSHLQLIYNLTICELNGTDWLNNHFS

SEQ ID NO: 875 - protein, 34 aa, Porcine reproductive and respiratory syndrome virus; identical to SEQ ID NO: 55

SEQ ID NO: 876 - protein, 34 aa, Porcine reproductive and respiratory syndrome virus
LVNADSNNSSHLQLIYNLTICELNGTDWLDKHFS

SEQ ID NO: 877 - protein, 34 aa, Porcine reproductive and respiratory syndrome virus
  misc_feature (17)..(17): Xaa can be any naturally occurring amino acid
LANASBNSSSHLQLIYXLTLCELNGTDWLANKFD

SEQ ID NO: 878 - protein, 34 aa, Porcine reproductive and respiratory syndrome virus
LVNASNNSSSHLQLIYNLTICELNGTDWLNKSFD

SEQ ID NO: 879 - protein, 34 aa, Porcine reproductive and respiratory syndrome virus
LVNANSSGSSHLQSIYNLTICELNGTDWLNNHFS

SEQ ID NO: 880 - protein, 34 aa, Porcine reproductive and respiratory syndrome virus
LVNANSNSSSHFQLIYNLTLCELNGTDWLAEKFN

SEQ ID NO: 881 - protein, 34 aa, Porcine reproductive and respiratory syndrome virus; identical to SEQ ID NO: 47

SEQ ID NO: 882 - protein, 34 aa, Porcine reproductive and respiratory syndrome virus
LVNANSNSSSHLQSIYNLTICELNGTHWLNNHFS

SEQ ID NO: 883 - protein, 34 aa, Porcine reproductive and respiratory syndrome virus; identical to SEQ ID NO: 39

SEQ ID NO: 884 - protein, 34 aa, Porcine reproductive and respiratory syndrome virus; identical to SEQ ID NO: 75

SEQ ID NO: 885 - protein, 34 aa, Porcine reproductive and respiratory syndrome virus; identical to SEQ ID NO: 663

SEQ ID NO: 886 - protein, 34 aa, Porcine reproductive and respiratory syndrome virus
LVNASNNNSSHLQLIYNLTICELNGTDWLDKHFS

SEQ ID NO: 887 - protein, 34 aa, Porcine reproductive and respiratory syndrome virus; identical to SEQ ID NO: 874

SEQ ID NO: 888 - protein, 34 aa, Porcine reproductive and respiratory syndrome virus
IVNAGSNSSSHIQLIYNLTLCELNGTDWLAGKFD

SEQ ID NO: 889 - protein, 34 aa, Porcine reproductive and respiratory syndrome virus
LVNANSNSSSHLQLIYNLTICELNGTNWLNNHFS

SEQ ID NO: 890 - protein, 34 aa, Porcine reproductive and respiratory syndrome virus; identical to SEQ ID NO: 886

SEQ ID NO: 891 - protein, 34 aa, Porcine reproductive and respiratory syndrome virus; identical to SEQ ID NO: 55

SEQ ID NO: 892 - protein, 34 aa, Porcine reproductive and respiratory syndrome virus; identical to SEQ ID NO: 483

SEQ ID NO: 893 - protein, 34 aa, Porcine reproductive and respiratory syndrome virus
LVNASGNSSSHFQLIYNLTLCELNGTDWLAEKFD

SEQ ID NO: 894 - protein, 34 aa, Porcine reproductive and respiratory syndrome virus
LANASANSSSHFQLIYNLTLCELNGTDWLANKFD

SEQ ID NO: 895 - protein, 34 aa, Porcine reproductive and respiratory syndrome virus; identical to SEQ ID NO: 876

SEQ ID NO: 896 - protein, 34 aa, Porcine reproductive and respiratory syndrome virus; identical to SEQ ID NO: 886

SEQ ID NO: 897 - protein, 34 aa, Porcine reproductive and respiratory syndrome virus
LVNASGNSSSHFQLIYNLTLCELNGTDWLAERFD

SEQ ID NO: 898 - protein, 34 aa, Porcine reproductive and respiratory syndrome virus
LVNANSTSSSHFQLIYNLTLCELNGTDWLAKKFD

SEQ ID NO: 899 - protein, 34 aa, Porcine reproductive and respiratory syndrome virus
LVNASGNSSSHFQLIYNLTLCELNGTDWLAKKFD

SEQ ID NO: 900 - protein, 34 aa, Porcine reproductive and respiratory syndrome virus; identical to SEQ ID NO: 47

SEQ ID NO: 901 - protein, 34 aa, Porcine reproductive and respiratory syndrome virus; identical to SEQ ID NO: 656

SEQ ID NO: 902 - protein, 34 aa, Porcine reproductive and respiratory syndrome virus; identical to SEQ ID NO: 680

SEQ ID NO: 903 - protein, 34 aa, Porcine reproductive and respiratory syndrome virus
LVNADSNHSSHFQSIYNLTLCELNGTDWLAKKFD

SEQ ID NO: 904 - protein, 34 aa, Porcine reproductive and respiratory syndrome virus; identical to SEQ ID NO: 267

SEQ ID NO: 905 - protein, 34 aa, Porcine reproductive and respiratory syndrome virus; identical to SEQ ID NO: 486

SEQ ID NO: 906 - protein, 34 aa, Porcine reproductive and respiratory syndrome virus
LVNADSNSSSHLQLIYNLTICELNGTEWLNNRFS

SEQ ID NO: 907 - protein, 34 aa, Porcine reproductive and respiratory syndrome virus
IANANSNSSSHIQLIYNLTLCELNGTDWLAGKFD

SEQ ID NO: 908 - protein, 34 aa, Porcine reproductive and respiratory syndrome virus; identical to SEQ ID NO: 39

SEQ ID NO: 909 - protein, 34 aa, Porcine reproductive and respiratory syndrome virus; identical to SEQ ID NO: 740

SEQ ID NO: 910 - protein, 34 aa, Porcine reproductive and respiratory syndrome virus
LVNANSNSSSHIQLIYNLTLCELNGTDWLANKFD

SEQ ID NO: 911 - protein, 34 aa, Porcine reproductive and respiratory syndrome virus; identical to SEQ ID NO: 47

SEQ ID NO: 912 - protein, 34 aa, Porcine reproductive and respiratory syndrome virus; identical to SEQ ID NO: 256

SEQ ID NO: 913 - protein, 34 aa, Porcine reproductive and respiratory syndrome virus; identical to SEQ ID NO: 499

SEQ ID NO: 914 - protein, 34 aa, Porcine reproductive and respiratory syndrome virus; identical to SEQ ID NO: 473

SEQ ID NO: 915 - protein, 34 aa, Porcine reproductive and respiratory syndrome virus; identical to SEQ ID NO: 694

SEQ ID NO: 916 - protein, 34 aa, Porcine reproductive and respiratory syndrome virus; identical to SEQ ID NO: 878

SEQ ID NO: 917 - protein, 34 aa, Porcine reproductive and respiratory syndrome virus
PVNANSNSSSHLQLIYNLTICELNGTDWLDRKFD

SEQ ID NO: 918 - protein, 34 aa, Porcine reproductive and respiratory syndrome virus
LVNASGNSSSHFQLIYNLTICELNGTDWLNDHFS

SEQ ID NO: 919 - protein, 34 aa, Porcine reproductive and respiratory syndrome virus; identical to SEQ ID NO: 449

SEQ ID NO: 920 - protein, 34 aa, Porcine reproductive and respiratory syndrome virus; identical to SEQ ID NO: 680

SEQ ID NO: 921 - protein, 34 aa, Porcine reproductive and respiratory syndrome virus
  misc_feature (14)..(14): Xaa can be any naturally occurring amino acid
LVNANSNSSSHLQXIYNLTICELNGTDWLNEHFS

SEQ ID NO: 922 - protein, 34 aa, Porcine reproductive and respiratory syndrome virus
  misc_feature (8)..(8): Xaa can be any naturally occurring amino acid
LVNANNSXSSHLQLIYNLTLCELNGTDWLANKFD

SEQ ID NO: 923 - protein, 34 aa, Porcine reproductive and respiratory syndrome virus; identical to SEQ ID NO: 486

SEQ ID NO: 924 - protein, 34 aa, Porcine reproductive and respiratory syndrome virus; identical to SEQ ID NO: 819

SEQ ID NO: 925 - protein, 34 aa, Porcine reproductive and respiratory syndrome virus; identical to SEQ ID NO: 680

SEQ ID NO: 926 - protein, 34 aa, Porcine reproductive and respiratory syndrome virus; identical to SEQ ID NO: 486

SEQ ID NO: 927 - protein, 34 aa, Porcine reproductive and respiratory syndrome virus; identical to SEQ ID NO: 486

SEQ ID NO: 928 - protein, 34 aa, Porcine reproductive and respiratory syndrome virus
LVNASTSSSSHLQLIYNLTICELNGTDWLGNHFS

SEQ ID NO: 929 - protein, 34 aa, Porcine reproductive and respiratory syndrome virus; identical to SEQ ID NO: 659

SEQ ID NO: 930 - protein, 34 aa, Porcine reproductive and respiratory syndrome virus
LANASSNNSSHLQLIYNLTLCELNGTDWLVNKFD

SEQ ID NO: 931 - protein, 34 aa, Porcine reproductive and respiratory syndrome virus; identical to SEQ ID NO: 680

SEQ ID NO: 932 - protein, 34 aa, Porcine reproductive and respiratory syndrome virus
  misc_feature (30)..(30): Xaa can be any naturally occurring amino acid
PANANNDSSSHLQLIYNLTLCELNGTDWLXNRFD

SEQ ID NO: 933 - protein, 34 aa, Porcine reproductive and respiratory syndrome virus
LANAHSNSSSHLQLIYNLTICELNGTDWLNKHFS

SEQ ID NO: 934 - protein, 34 aa, Porcine reproductive and respiratory syndrome virus
LVSANQNNSSHLQLIYNLTLCELNGTDWLANKFD

SEQ ID NO: 935 - protein, 34 aa, Porcine reproductive and respiratory syndrome virus
LVNASNGSSSHLQLIYNLTLCELNGTDWLATKFD

SEQ ID NO: 936 - protein, 34 aa, Porcine reproductive and respiratory syndrome virus
LVNASNSSSSHLQLIYNLTICELNGTDWLKNHFS

SEQ ID NO: 937 - protein, 34 aa, Porcine reproductive and respiratory syndrome virus; identical to SEQ ID NO: 755

SEQ ID NO: 938 - protein, 33 aa, Porcine reproductive and respiratory syndrome virus
VNANANSSSKLQLIYNLTLCELNGTDWLANKFD

SEQ ID NO: 939 - protein, 34 aa, Porcine reproductive and respiratory syndrome virus
LVNASSNSSSHLQLIYNLTICELNGTDWLENHFS

SEQ ID NO: 940 - protein, 34 aa, Porcine reproductive and respiratory syndrome virus
  misc_feature (6)..(6): Xaa can be any naturally occurring amino acid
  misc_feature (27)..(27): Xaa can be any naturally occurring amino acid
LVNASXNSSSHLQLIYNLTICELNGTXWLENHFS

SEQ ID NO: 941 - protein, 34 aa, Porcine reproductive and respiratory syndrome virus; identical to SEQ ID NO: 267

SEQ ID NO: 942 - protein, 34 aa, Porcine reproductive and respiratory syndrome virus
PVNANSNSSSHLQLIYNLTICELNGTDWLNEHFS

SEQ ID NO: 943 - protein, 34 aa, Porcine reproductive and respiratory syndrome virus
LVNANSNSSSHLQLIYNLTICELNGTDWLDKHFS

SEQ ID NO: 944 - protein, 34 aa, Porcine reproductive and respiratory syndrome virus
LVNANSNSSSHFQLIYKLTLCELNGTDWLAKKFD

SEQ ID NO: 945 - protein, 34 aa, Porcine reproductive and respiratory syndrome virus
LVNANSNSSSHLQLIYNLTICELNGTDWLNKHFS

SEQ ID NO: 946 - protein, 34 aa, Porcine reproductive and respiratory syndrome virus; identical to SEQ ID NO: 803

SEQ ID NO: 947 - protein, 34 aa, Porcine reproductive and respiratory syndrome virus; identical to SEQ ID NO: 694

SEQ ID NO: 948 - protein, 34 aa, Porcine reproductive and respiratory syndrome virus
LVGANSNSSSHFQLIYNLTLCELNGTDWLDNKFD

SEQ ID NO: 949 - protein, 34 aa, Porcine reproductive and respiratory syndrome virus
LVNAHSNSSSHLQLIYNLTICELNGTDWLNKHFS

SEQ ID NO: 950 - protein, 34 aa, Porcine reproductive and respiratory syndrome virus
LVNADNNSSSHLQLIYNLTICELNGTDWLNKKFD

SEQ ID NO: 951 - protein, 34 aa, Porcine reproductive and respiratory syndrome virus
LVNADNNSSSHLQLIYNLTICELNGTEWLNKKFD

SEQ ID NO: 952 - protein, 34 aa, Porcine reproductive and respiratory syndrome virus
IVNANSNSSSHIQLIYNLTLCELNGTDWLADKFD

SEQ ID NO: 953 - protein, 34 aa, Porcine reproductive and respiratory syndrome virus; identical to SEQ ID NO: 933

SEQ ID NO: 954 - protein, 34 aa, Porcine reproductive and respiratory syndrome virus; identical to SEQ ID NO: 802

SEQ ID NO: 955 - protein, 34 aa, Porcine reproductive and respiratory syndrome virus; identical to SEQ ID NO: 486

SEQ ID NO: 956 - protein, 34 aa, Porcine reproductive and respiratory syndrome virus
LVNADSSNSSHLQLIYNLTICELNGTDWLDRHFS

SEQ ID NO: 957 - protein, 34 aa, Porcine reproductive and respiratory syndrome virus; identical to SEQ ID NO: 874

SEQ ID NO: 958 - protein, 34 aa, Porcine reproductive and respiratory syndrome virus
LVNAGSNSSSHLQLIYNLTICELNGTEWLBNHFS

SEQ ID NO: 959 - protein, 34 aa, Porcine reproductive and respiratory syndrome virus
LVNANSSSSSHFQLIYNLTICELNGTDWLNDHFS

SEQ ID NO: 960 - protein, 34 aa, Porcine reproductive and respiratory syndrome virus
LVDANSNSSSHFQLIYNLTLCELNGTDWLNDKFN

SEQ ID NO: 961 - protein, 34 aa, Porcine reproductive and respiratory syndrome virus; identical to SEQ ID NO: 267

SEQ ID NO: 962 - protein, 34 aa, Porcine reproductive and respiratory syndrome virus
LVNADSNSSSHLQSIYNLTICELNGTDWLNNHFS

SEQ ID NO: 963 - protein, 34 aa, Porcine reproductive and respiratory syndrome virus
PANAGDSSSSHLQLIYNLTLCELNGTDWLANKFD

SEQ ID NO: 964 - protein, 34 aa, Porcine reproductive and respiratory syndrome virus
LANASSDSSSHLQLIYNLTLCELNGTDWLADKFD

SEQ ID NO: 965 - protein, 34 aa, Porcine reproductive and respiratory syndrome virus
LVNASNNNSSHLQLIYNLTICELNGTDWLNEHFS

SEQ ID NO: 966 - protein, 34 aa, Porcine reproductive and respiratory syndrome virus; identical to SEQ ID NO: 933

SEQ ID NO: 967 - protein, 34 aa, Porcine reproductive and respiratory syndrome virus
LVNASNNASSHLQLIYNLTICELNGTDWLNKHFS

SEQ ID NO: 968 - protein, 34 aa, Porcine reproductive and respiratory syndrome virus
LVNANNNSSSHLQLIYNLTICELNGTDWLNDHFR

SEQ ID NO: 969 - protein, 34 aa, Porcine reproductive and respiratory syndrome virus; identical to SEQ ID NO: 945

SEQ ID NO: 970 - protein, 34 aa, Porcine reproductive and respiratory syndrome virus
LVNANSNSSSHFQLIYNLTLCELNGTDWLATRFD

SEQ ID NO: 971 - protein, 34 aa, Porcine reproductive and respiratory syndrome virus
  misc_feature (27)..(27): Xaa can be any naturally occurring amino acid
LVNASNNTSSHLQLIYNLTICELNGTXWLNKHFN

SEQ ID NO: 972 - protein, 34 aa, Porcine reproductive and respiratory syndrome virus; identical to SEQ ID NO: 945

SEQ ID NO: 973 - protein, 34 aa, Porcine reproductive and respiratory syndrome virus; identical to SEQ ID NO: 907

SEQ ID NO: 974 - protein, 34 aa, Porcine reproductive and respiratory syndrome virus
LVNAGSNSSSHLQLIYNLTICELNGTGWLNNHFS

SEQ ID NO: 975 - protein, 34 aa, Porcine reproductive and respiratory syndrome virus; identical to SEQ ID NO: 267

SEQ ID NO: 976 - protein, 34 aa, Porcine reproductive and respiratory syndrome virus; identical to SEQ ID NO: 55

SEQ ID NO: 977 - protein, 34 aa, Porcine reproductive and respiratory syndrome virus; identical to SEQ ID NO: 449

SEQ ID NO: 978 - protein, 34 aa, Porcine reproductive and respiratory syndrome virus; identical to SEQ ID NO: 827

SEQ ID NO: 979 - protein, 34 aa, Porcine reproductive and respiratory syndrome virus; identical to SEQ ID NO: 819

SEQ ID NO: 980 - protein, 34 aa, Porcine reproductive and respiratory syndrome virus; identical to SEQ ID NO: 720

SEQ ID NO: 981 - protein, 34 aa, Porcine reproductive and respiratory syndrome virus
LVNAHSNSSSHLQLIYNLTICELNGTDWLDKHFS

SEQ ID NO: 982 - protein, 34 aa, Porcine reproductive and respiratory syndrome virus; identical to SEQ ID NO: 47

SEQ ID NO: 983 - protein, 34 aa, Porcine reproductive and respiratory syndrome virus; identical to SEQ ID NO: 235

SEQ ID NO: 984 - protein, 34 aa, Porcine reproductive and respiratory syndrome virus
LVNASNNSSSHLQLIYNLTICELNGTEWLNNHFS

SEQ ID NO: 985 - protein, 34 aa, Porcine reproductive and respiratory syndrome virus
SFADGNGNNSTYQYIYNLTICELNGTDWLSDHFS

SEQ ID NO: 986 - protein, 34 aa, Porcine reproductive and respiratory syndrome virus; identical to SEQ ID NO: 486

SEQ ID NO: 987 - protein, 34 aa, Porcine reproductive and respiratory syndrome virus
LANAHSNSSSHLQLIYNLTICELNGTDWLDKHFS

SEQ ID NO: 988 - protein, 34 aa, Porcine reproductive and respiratory syndrome virus
LVNANSSSSSHLQLIYNLTICELNGTDWLKDKFE

SEQ ID NO: 989 - protein, 34 aa, Porcine reproductive and respiratory syndrome virus
LVNASNNNSSHLQLIYNLTICELNGTDWLNSHFS

SEQ ID NO: 990 - protein, 34 aa, Porcine reproductive and respiratory syndrome virus
LVNANSNSSSHLQLIYNLTICELNGTEWLNNKFS

SEQ ID NO: 991 - protein, 34 aa, Porcine reproductive and respiratory syndrome virus; identical to SEQ ID NO: 267

SEQ ID NO: 992 - protein, 34 aa, Porcine reproductive and respiratory syndrome virus
LVNANSNSSSHFQLIYNLTLCELNGTDWLNKKFD

SEQ ID NO: 993 - protein, 34 aa, Porcine reproductive and respiratory syndrome virus
LVNANGNSSSHFQLIYNLTLCELNGTEWLGNKFD

SEQ ID NO: 994 - protein, 34 aa, Porcine reproductive and respiratory syndrome virus
LVNANSNSSSHFQSIYNLTLCELNGTDWLAGKFD

SEQ ID NO: 995 - protein, 34 aa, Porcine reproductive and respiratory syndrome virus; identical to SEQ ID NO: 743

SEQ ID NO: 996 - protein, 34 aa, Porcine reproductive and respiratory syndrome virus
LVNASNNSSSHLQLIYNLTICELNGTDWLNNHFS

SEQ ID NO: 997 - protein, 34 aa, Porcine reproductive and respiratory syndrome virus; identical to SEQ ID NO: 686

SEQ ID NO: 998 - protein, 34 aa, Porcine reproductive and respiratory syndrome virus; identical to SEQ ID NO: 910

SEQ ID NO: 999 - protein, 33 aa, Porcine reproductive and respiratory syndrome virus
LVNASNSSSHFQLIYNLTLCELNGTDWLANKFD

SEQ ID NO: 1000 - protein, 34 aa, Porcine reproductive and respiratory syndrome virus
IVNASSNSSSHIQLIYNLTICELNGTDWLNYKFD

SEQ ID NO: 1001 - protein, 34 aa, Porcine reproductive and respiratory syndrome virus
LVDANSNSSSHLQLIYNLTICELNGTDWLKNNFD

SEQ ID NO: 1002 - protein, 34 aa, Porcine reproductive and respiratory syndrome virus
LVNANSNSSSHFQLIYNLTLCELNGTDWLAERFD

SEQ ID NO: 1003 - protein, 34 aa, Porcine reproductive and respiratory syndrome virus; identical to SEQ ID NO: 996

SEQ ID NO: 1004 - protein, 34 aa, Porcine reproductive and respiratory syndrome virus; identical to SEQ ID NO: 910

SEQ ID NO: 1005 - protein, 34 aa, Porcine reproductive and respiratory syndrome virus
LVNANSTSSSHFQLIYNLTLCELNGTDWLANKFD

SEQ ID NO: 1006 - protein, 34 aa, Porcine reproductive and respiratory syndrome virus; identical to SEQ ID NO: 229

SEQ ID NO: 1007 - protein, 34 aa, Porcine reproductive and respiratory syndrome virus
LVNANSNNSSHLQLIYNLTICELNGTDWLDKKFD

SEQ ID NO: 1008 - protein, 34 aa, Porcine reproductive and respiratory syndrome virus; identical to SEQ ID NO: 20

SEQ ID NO: 1009 - protein, 34 aa, Porcine reproductive and respiratory syndrome virus
LVNASSNNSSHLQLIYNLTICELNGTDWLDKRFS

SEQ ID NO: 1010 - protein, 34 aa, Porcine reproductive and respiratory syndrome virus; identical to SEQ ID NO: 350

SEQ ID NO: 1011 - protein, 34 aa, Porcine reproductive and respiratory syndrome virus; identical to SEQ ID NO: 484

SEQ ID NO: 1012 - protein, 34 aa, Porcine reproductive and respiratory syndrome virus
LVNASGNSSSHFQLIYNLTICELNGTEWLDDHFS

SEQ ID NO: 1013 - protein, 34 aa, Porcine reproductive and respiratory syndrome virus
LVNADSNSSSHLQLIYNLTICELNGTDWLNKNFS

SEQ ID NO: 1014 - protein, 34 aa, Porcine reproductive and respiratory syndrome virus; identical to SEQ ID NO: 188

SEQ ID NO: 1015 - protein, 34 aa, Porcine reproductive and respiratory syndrome virus; identical to SEQ ID NO: 936

SEQ ID NO: 1016 - protein, 34 aa, Porcine reproductive and respiratory syndrome virus
LANANSNSSSHLQLIYNLTLCELNGTDWLVGKFD

SEQ ID NO: 1017 - protein, 34 aa, Porcine reproductive and respiratory syndrome virus
LVNANSNSSSHLQLIYNLTICELNGTDWLNDKFD

SEQ ID NO: 1018 - protein, 34 aa, Porcine reproductive and respiratory syndrome virus; identical to SEQ ID NO: 188

SEQ ID NO: 1019 - protein, 34 aa, Porcine reproductive and respiratory syndrome virus; identical to SEQ ID NO: 768

SEQ ID NO: 1020 - protein, 34 aa, Porcine reproductive and respiratory syndrome virus
LVNATSNSSSHLQLIYNLTLCELNGTDWLGEKFD

SEQ ID NO: 1021 - protein, 34 aa, Porcine reproductive and respiratory syndrome virus
LVNASSNNSSHLQLIYNLTICELNGTEWLNNHFS

SEQ ID NO: 1022 - protein, 34 aa, Porcine reproductive and respiratory syndrome virus
LVNANSNSSSHLQLIYNLTICELNGTDWLKNHFS

SEQ ID NO: 1023 - protein, 34 aa, Porcine reproductive and respiratory syndrome virus
LVNANGNSSSHLQLIYNLTLCELNGTDWLAKRFD

SEQ ID NO: 1024 - protein, 34 aa, Porcine reproductive and respiratory syndrome virus; identical to SEQ ID NO: 39

SEQ ID NO: 1025 - protein, 34 aa, Porcine reproductive and respiratory syndrome virus
LVNANSNSSSHLQLIYNLTICELNGTDWLYNHFS

SEQ ID NO: 1026 - protein, 34 aa, Porcine reproductive and respiratory syndrome virus
LVNASGNSSSHLQLIYNLTICELNGTEWLGNHFS

SEQ ID NO: 1027 - protein, 34 aa, Porcine reproductive and respiratory syndrome virus; identical to SEQ ID NO: 188

SEQ ID NO: 1028 - protein, 34 aa, Porcine reproductive and respiratory syndrome virus; identical to SEQ ID NO: 604

SEQ ID NO: 1029 - protein, 34 aa, Porcine reproductive and respiratory syndrome virus
LVNASSNSSSHLQLIYNLTICELNGTDWLDKRFD

SEQ ID NO: 1030 - protein, 34 aa, Porcine reproductive and respiratory syndrome virus; identical to SEQ ID NO: 910

SEQ ID NO: 1031 - protein, 34 aa, Porcine reproductive and respiratory syndrome virus
LVNASNNSSSHLQLIYNLTICELNGTDWLNEHFS

SEQ ID NO: 1032 - protein, 34 aa, Porcine reproductive and respiratory syndrome virus; identical to SEQ ID NO: 694

SEQ ID NO: 1033 - protein, 34 aa, Porcine reproductive and respiratory syndrome virus
  misc_feature (5)..(6): Xaa can be any naturally occurring amino acid
LVNAXXNSSSHLQLIYNLTICELNGTDWLNNHFS

SEQ ID NO: 1034 - protein, 34 aa, Porcine reproductive and respiratory syndrome virus; identical to SEQ ID NO: 680

SEQ ID NO: 1035 - protein, 34 aa, Porcine reproductive and respiratory syndrome virus
  misc_feature (30)..(30): Xaa can be any naturally occurring amino acid
LVNAGSNSSSHLQLIYNLTICELNGTDWLXDHFS

SEQ ID NO: 1036 - protein, 34 aa, Porcine reproductive and respiratory syndrome virus
IVNASNDSSSHLQLIYNLTICELNGTEWLNNHFS

SEQ ID NO: 1037 - protein, 34 aa, Porcine reproductive and respiratory syndrome virus
LVNANSBSSSHIQLIYNLTLCELNGTDWLANKFD

SEQ ID NO: 1038 - protein, 34 aa, Porcine reproductive and respiratory syndrome virus
LVNANSNSSSHLQLIYKLTICELNGTDWLNEHFS

SEQ ID NO: 1039 - protein, 34 aa, Porcine reproductive and respiratory syndrome virus
LVNASGNSSSHFQLIYNLTLCELNGTDWLADKFD

SEQ ID NO: 1040 - protein, 34 aa, Porcine reproductive and respiratory syndrome virus
LVNAHSNSSSHLQLIYNLTICELNGTDWLNNHFS

SEQ ID NO: 1041 - protein, 34 aa, Porcine reproductive and respiratory syndrome virus
  misc_feature (32)..(32): Xaa can be any naturally occurring amino acid
LVNANSNSSSHLQLIYNLTICELNGTDWLNNXFS

SEQ ID NO: 1042 - protein, 34 aa, Porcine reproductive and respiratory syndrome virus; identical to SEQ ID NO: 484

SEQ ID NO: 1043 - protein, 34 aa, Porcine reproductive and respiratory syndrome virus
LVNANNTSSSHFQLIYNLTLCELNGTDWLANKFD

SEQ ID NO: 1044 - protein, 34 aa, Porcine reproductive and respiratory syndrome virus; identical to SEQ ID NO: 486

SEQ ID NO: 1045 - protein, 34 aa, Porcine reproductive and respiratory syndrome virus
LVNANSNSSSHLQLIYNLTICELNGTDWLNNRFS

SEQ ID NO: 1046 - protein, 34 aa, Porcine reproductive and respiratory syndrome virus
LVNANSNSSSHFQLIYNLTICELNGTDWLSNKFD

SEQ ID NO: 1047 - protein, 34 aa, Porcine reproductive and respiratory syndrome virus; identical to SEQ ID NO: 943

SEQ ID NO: 1048 - protein, 34 aa, Porcine reproductive and respiratory syndrome virus; identical to SEQ ID NO: 350

SEQ ID NO: 1049 - protein, 34 aa, Porcine reproductive and respiratory syndrome virus
LVNANNNSSSHLQLIYNLTICELNGTDWLNKSFD

SEQ ID NO: 1050 - protein, 34 aa, Porcine reproductive and respiratory syndrome virus; identical to SEQ ID NO: 786

SEQ ID NO: 1051 - protein, 34 aa, Porcine reproductive and respiratory syndrome virus; identical to SEQ ID NO: 188

SEQ ID NO: 1052 - protein, 34 aa, Porcine reproductive and respiratory syndrome virus
LVNANSNSSSHFQLIYNLTLCELNGTEWLGNKFD

SEQ ID NO: 1053 - protein, 34 aa, Porcine reproductive and respiratory syndrome virus; identical to SEQ ID NO: 267

SEQ ID NO: 1054 - protein, 34 aa, Porcine reproductive and respiratory syndrome virus
LVNAHSNSSSHLQLIYNLTICELNGTEWLNNHFS

SEQ ID NO: 1055 - protein, 34 aa, Porcine reproductive and respiratory syndrome virus; identical to SEQ ID NO: 486

SEQ ID NO: 1056 - protein, 34 aa, Porcine reproductive and respiratory syndrome virus
LANANSNSSSHLQLIYNLTLCELNGTDWLADKFD

SEQ ID NO: 1057 - protein, 34 aa, Porcine reproductive and respiratory syndrome virus
LVNASNDSSSHLQLIYNLTICELNGTDWLNNKFD

SEQ ID NO: 1058 - protein, 34 aa, Porcine reproductive and respiratory syndrome virus
LVNANSNSSSHFQLIYNLTICELNGTDWLNEHFS

SEQ ID NO: 1059 - protein, 34 aa, Porcine reproductive and respiratory syndrome virus; identical to SEQ ID NO: 350

SEQ ID NO: 1060 - protein, 34 aa, Porcine reproductive and respiratory syndrome virus; identical to SEQ ID NO: 680

SEQ ID NO: 1061 - protein, 34 aa, Porcine reproductive and respiratory syndrome virus
LVNASGNSSSHLQLIYNLTICELNGTDWLNNKFD

SEQ ID NO: 1062 - protein, 34 aa, Porcine reproductive and respiratory syndrome virus
LVNAESNSSSHFQLIYNLTICELNGTDWLNNHFS

SEQ ID NO: 1063 - protein, 34 aa, Porcine reproductive and respiratory syndrome virus
LVNANSNSSSHFQLIYNLTLCELNGTDWLNNKFD

SEQ ID NO: 1064 - protein, 34 aa, Porcine reproductive and respiratory syndrome virus
  misc_feature (7)..(7): Xaa can be any naturally occurring amino acid
LVNANSXSSSHLQLIYNLTICELNGTDWLNNHFS

SEQ ID NO: 1065 - protein, 34 aa, Porcine reproductive and respiratory syndrome virus; identical to SEQ ID NO: 542

SEQ ID NO: 1066 - protein, 34 aa, Porcine reproductive and respiratory syndrome virus
  misc_feature (30)..(30): Xaa can be any naturally occurring amino acid
LVNADSNSSSHLQLIYNLTICELNGTBWLXNHFS

SEQ ID NO: 1067 - protein, 34 aa, Porcine reproductive and respiratory syndrome virus; identical to SEQ ID NO: 874

SEQ ID NO: 1068 - protein, 34 aa, Porcine reproductive and respiratory syndrome virus; identical to SEQ ID NO: 75

SEQ ID NO: 1069 - protein, 34 aa, Porcine reproductive and respiratory syndrome virus
LVNANNNSSSHLQLIYNLTICELNGTDWLNNTFD

SEQ ID NO: 1070 - protein, 34 aa, Porcine reproductive and respiratory syndrome virus; identical to SEQ ID NO: 962

SEQ ID NO: 1071 - protein, 34 aa, Porcine reproductive and respiratory syndrome virus
LVNANSDSSSHLQLIYNLTICELNGTDWLNEHFS

SEQ ID NO: 1072 - protein, 34 aa, Porcine reproductive and respiratory syndrome virus; identical to SEQ ID NO: 487

SEQ ID NO: 1073 - protein, 34 aa, Porcine reproductive and respiratory syndrome virus
LVNANSSNSSHLQLIYNLTICELNGTDWLNNHFS

SEQ ID NO: 1074 - protein, 34 aa, Porcine reproductive and respiratory syndrome virus; identical to SEQ ID NO: 267

SEQ ID NO: 1075 - protein, 34 aa, Porcine reproductive and respiratory syndrome virus; identical to SEQ ID NO: 680

SEQ ID NO: 1076 - protein, 34 aa, Porcine reproductive and respiratory syndrome virus
LVNAGSNSSSHLQLIYNLTICELNGTGWLNDHFS

SEQ ID NO: 1077 - protein, 34 aa, Porcine reproductive and respiratory syndrome virus
LVSANNSSSSHLQLIYNMTLCELNGTDWLASRFD

SEQ ID NO: 1078 - protein, 34 aa, Porcine reproductive and respiratory syndrome virus
LVNASNNSSSHLQLIYNLTICELNGTGWLNEHFS

SEQ ID NO: 1079 - protein, 34 aa, Porcine reproductive and respiratory syndrome virus; identical to SEQ ID NO: 188

SEQ ID NO: 1080 - protein, 34 aa, Porcine reproductive and respiratory syndrome virus
LVNANSSSSSHFQLIYNLTLCELNGTDWLAQKFD

SEQ ID NO: 1081 - protein, 34 aa, Porcine reproductive and respiratory syndrome virus; identical to SEQ ID NO: 475

SEQ ID NO: 1082 - protein, 34 aa, Porcine reproductive and respiratory syndrome virus; identical to SEQ ID NO: 267

SEQ ID NO: 1083 - protein, 34 aa, Porcine reproductive and respiratory syndrome virus
LVNADNNSSSHLQLIYNLTICELNGTDWLNEKFD

SEQ ID NO: 1084 - protein, 34 aa, Porcine reproductive and respiratory syndrome virus
LANASDNSSSHLQLIYNLTLCELNGTDWLAGKFD

SEQ ID NO: 1085 - protein, 34 aa, Porcine reproductive and respiratory syndrome virus; identical to SEQ ID NO: 1039

SEQ ID NO: 1086 - protein, 34 aa, Porcine reproductive and respiratory syndrome virus; identical to SEQ ID NO: 481

SEQ ID NO: 1087 - protein, 34 aa, Porcine reproductive and respiratory syndrome virus
LVNANSSSSSHLQLIYNLTLCELNGTDWLQDKFD

SEQ ID NO: 1088 - protein, 34 aa, Porcine reproductive and respiratory syndrome virus
LVNANSDSSSHLQLIYNLTICELNGTDWLGNKFD

SEQ ID NO: 1089 - protein, 34 aa, Porcine reproductive and respiratory syndrome virus
LVNANSNSSSHIQLIYNLTLCELNGTDWLANEFD

SEQ ID NO: 1090 - protein, 34 aa, Porcine reproductive and respiratory syndrome virus
LVNASNDSSSHLQLIYNLTICELNGTDWLNEHFS

SEQ ID NO: 1091 - protein, 34 aa, Porcine reproductive and respiratory syndrome virus; identical to SEQ ID NO: 350

SEQ ID NO: 1092 - protein, 34 aa, Porcine reproductive and respiratory syndrome virus
LVNANQNSSSHLQLIYNLTICELNGTDWLRDKFN

SEQ ID NO: 1093 - protein, 34 aa, Porcine reproductive and respiratory syndrome virus
LVNANSSSSSHLQLIYNLTLCELNGTDWLGDKFD

SEQ ID NO: 1094 - protein, 34 aa, Porcine reproductive and respiratory syndrome virus
LVNANSSSSSHLQLIYNLTICELNGTDWLDGHFS

SEQ ID NO: 1095 - protein, 34 aa, Porcine reproductive and respiratory syndrome virus; identical to SEQ ID NO: 519

SEQ ID NO: 1096 - protein, 34 aa, Porcine reproductive and respiratory syndrome virus
LVNASNNNSSHLQLIYNLTICELNGTEWLNDHFS

SEQ ID NO: 1097 - protein, 34 aa, Porcine reproductive and respiratory syndrome virus
LVNANSNSSSHFQLIYNLTLCELNGTEWLGSKFD

SEQ ID NO: 1098 - protein, 34 aa, Porcine reproductive and respiratory syndrome virus
LVNASSDNSSHLQLIYNLTICELNGTDWLDKHFS

SEQ ID NO: 1099 - protein, 34 aa, Porcine reproductive and respiratory syndrome virus
LVNANSNSSSHLQSIYNLTICELNGTDWLNNRFS

SEQ ID NO: 1100 - protein, 34 aa, Porcine reproductive and respiratory syndrome virus
LVNASSNSSSHLQLIYNLTICELNGTDWLDNHFS

SEQ ID NO: 1101 - protein, 34 aa, Porcine reproductive and respiratory syndrome virus
LVNANSNSSSHLQLIYNLTLCELNGTDWLRDKFG

SEQ ID NO: 1102 - protein, 34 aa, Porcine reproductive and respiratory syndrome virus; identical to SEQ ID NO: 680

SEQ ID NO: 1103 - protein, 34 aa, Porcine reproductive and respiratory syndrome virus; identical to SEQ ID NO: 819

SEQ ID NO: 1104 - protein, 34 aa, Porcine reproductive and respiratory syndrome virus
LVNANSNSSSHLQLIYNLTICELNGTDWLDGHFS

SEQ ID NO: 1105 - protein, 34 aa, Porcine reproductive and respiratory syndrome virus; identical to SEQ ID NO: 878

SEQ ID NO: 1106 - protein, 34 aa, Porcine reproductive and respiratory syndrome virus; identical to SEQ ID NO: 350

SEQ ID NO: 1107 - protein, 34 aa, Porcine reproductive and respiratory syndrome virus
LVNAKGNSSSHLQLIYNLTLCELNGTDWLKDKFD

SEQ ID NO: 1108 - protein, 34 aa, Porcine reproductive and respiratory syndrome virus; identical to SEQ ID NO: 680

SEQ ID NO: 1109 - protein, 34 aa, Porcine reproductive and respiratory syndrome virus
LVNANSSHSSHFQLIYNLTLCELNGTDWLANKFD

SEQ ID NO: 1110 - protein, 34 aa, Porcine reproductive and respiratory syndrome virus
IVNANSTSSSHLQLIYNLTLCELNGTDWLADKFD

SEQ ID NO: 1111 - protein, 34 aa, Porcine reproductive and respiratory syndrome virus; identical to SEQ ID NO: 878

SEQ ID NO: 1112 - protein, 34 aa, Porcine reproductive and respiratory syndrome virus; identical to SEQ ID NO: 737

SEQ ID NO: 1113 - protein, 34 aa, Porcine reproductive and respiratory syndrome virus; identical to SEQ ID NO: 461

SEQ ID NO: 1114 - protein, 34 aa, Porcine reproductive and respiratory syndrome virus; identical to SEQ ID NO: 513

SEQ ID NO: 1115 - protein, 34 aa, Porcine reproductive and respiratory syndrome virus
LVNASNNSSSHLQLIYNLTLCELNGTDWLANNFD

SEQ ID NO: 1116 - protein, 34 aa, Porcine reproductive and respiratory syndrome virus; identical to SEQ ID NO: 690

SEQ ID NO: 1117 - protein, 34 aa, Porcine reproductive and respiratory syndrome virus; identical to SEQ ID NO: 987

SEQ ID NO: 1118 - protein, 34 aa, Porcine reproductive and respiratory syndrome virus
LVNASNNNSSHLQLIYNLTICELNGTDWLNKHFS

SEQ ID NO: 1119 - protein, 34 aa, Porcine reproductive and respiratory syndrome virus
LVNASNNSSSHLQLIYNLTICELNGTDWLNERFN

SEQ ID NO: 1120 - protein, 34 aa, Porcine reproductive and respiratory syndrome virus; identical to SEQ ID NO: 563

SEQ ID NO: 1121 - protein, 34 aa, Porcine reproductive and respiratory syndrome virus
LVNASGNSSSHLQLIYNLTICELNGTDWLNDHFS

SEQ ID NO: 1122 - protein, 34 aa, Porcine reproductive and respiratory syndrome virus; identical to SEQ ID NO: 655

SEQ ID NO: 1123 - protein, 34 aa, Porcine reproductive and respiratory syndrome virus; identical to SEQ ID NO: 267

SEQ ID NO: 1124 - protein, 34 aa, Porcine reproductive and respiratory syndrome virus
LVNASDNNSSHLQLIYNLTICELNGTDWLNKHFS

SEQ ID NO: 1125 - protein, 34 aa, Porcine reproductive and respiratory syndrome virus; identical to SEQ ID NO: 686

SEQ ID NO: 1126 - protein, 34 aa, Porcine reproductive and respiratory syndrome virus; identical to SEQ ID NO: 55

SEQ ID NO: 1127 - protein, 34 aa, Porcine reproductive and respiratory syndrome virus
LVNANSNSSSHFQLIYNLTLCELNGTDWLRDKFD

SEQ ID NO: 1128 - protein, 34 aa, Porcine reproductive and respiratory syndrome virus
LVNANSNSSSHLQLIYNLTICELNGTDWLDSHFS

SEQ ID NO: 1129 - protein, 34 aa, Porcine reproductive and respiratory syndrome virus; identical to SEQ ID NO: 720

SEQ ID NO: 1130 - protein, 34 aa, Porcine reproductive and respiratory syndrome virus
LANAHSNSSSHLQLIYNLTICELNGTDWLNRHFS

SEQ ID NO: 1131 - protein, 34 aa, Porcine reproductive and respiratory syndrome virus
LANAQSNSSSHLQLIYNLTICELNGTDWLNRHFS

SEQ ID NO: 1132 - protein, 34 aa, Porcine reproductive and respiratory syndrome virus; identical to SEQ ID NO: 250

SEQ ID NO: 1133 - protein, 34 aa, Porcine reproductive and respiratory syndrome virus; identical to SEQ ID NO: 236

SEQ ID NO: 1134 - protein, 34 aa, Porcine reproductive and respiratory syndrome virus
  misc_feature (3)..(3): Xaa can be any naturally occurring amino acid
LVXANSNSSSHLQLIYNLTICELNGTDWLNDKFN

SEQ ID NO: 1135 - protein, 34 aa, Porcine reproductive and respiratory syndrome virus
LVNANRNSSSHLQLIYNLTLCELNGTDWLKDKFD

SEQ ID NO: 1136 - protein, 34 aa, Porcine reproductive and respiratory syndrome virus; identical to SEQ ID NO: 75

SEQ ID NO: 1137 - protein, 34 aa, Porcine reproductive and respiratory syndrome virus; identical to SEQ ID NO: 481

SEQ ID NO: 1138 - protein, 34 aa, Porcine reproductive and respiratory syndrome virus
LANASSNNSSHLQLIYNLTLCELNGTDWLANKFD

SEQ ID NO: 1139 - protein, 34 aa, Porcine reproductive and respiratory syndrome virus; identical to SEQ ID NO: 267

SEQ ID NO: 1140 - protein, 34 aa, Porcine reproductive and respiratory syndrome virus
SFADGNGNNSTYQYIYNLTICELNGTKWLSGHFE

SEQ ID NO: 1141 - protein, 34 aa, Porcine reproductive and respiratory syndrome virus
LANANSNSSSHLQLIYNLTLCELNGTDWLANKFD

SEQ ID NO: 1142 - protein, 34 aa, Porcine reproductive and respiratory syndrome virus
LANASNHSSSHLQLIYNLTLCELNGTDWLANKFD

SEQ ID NO: 1143 - protein, 34 aa, Porcine reproductive and respiratory syndrome virus; identical to SEQ ID NO: 47

SEQ ID NO: 1144 - protein, 34 aa, Porcine reproductive and respiratory syndrome virus
PANASNDSSSHLQLIYNLTLCELNGTDWLANKFD

SEQ ID NO: 1145 - protein, 34 aa, Porcine reproductive and respiratory syndrome virus; identical to SEQ ID NO: 486

SEQ ID NO: 1146 - protein, 33 aa, Porcine reproductive and respiratory syndrome virus
VNANSNSSSHLQLIYNLTICELNGTEWLGRKFD

SEQ ID NO: 1147 - protein, 34 aa, Porcine reproductive and respiratory syndrome virus
LVNASSNSSSHLQLIYNLTICELNGTDWLNKHFG

SEQ ID NO: 1148 - protein, 34 aa, Porcine reproductive and respiratory syndrome virus
LVNANSNSSSHLQLIYNLTICELNGTDWLDNHFS

SEQ ID NO: 1149 - protein, 34 aa, Porcine reproductive and respiratory syndrome virus
LANASSNNSSHLQLIYNLTICELNGTDWLNNHFS

SEQ ID NO: 1150 - protein, 34 aa, Porcine reproductive and respiratory syndrome virus
LVNAENNSSSHLQLIYNLTICELNGTDWLNKKFD

SEQ ID NO: 1151 - protein, 34 aa, Porcine reproductive and respiratory syndrome virus
LVNAHSNSSSHLQLIYNLTICELNGTEWLNNRFS

SEQ ID NO: 1152 - protein, 34 aa, Porcine reproductive and respiratory syndrome virus
LVNANSNSSSHFQLIYNLTLCELNGTDWLAQRFD

SEQ ID NO: 1153 - protein, 34 aa, Porcine reproductive and respiratory syndrome virus
LVNASNNHSSHFQLIYNLTLCELNGTDWLANKFD

SEQ ID NO: 1154 - protein, 34 aa, Porcine reproductive and respiratory syndrome virus; identical to SEQ ID NO: 765

SEQ ID NO: 1155 - protein, 34 aa, Porcine reproductive and respiratory syndrome virus; identical to SEQ ID NO: 765

SEQ ID NO: 1156 - protein, 34 aa, Porcine reproductive and respiratory syndrome virus
LVNASNNGSSHLQLIYNLTICELNGTDWLNDKFD

SEQ ID NO: 1157 - protein, 34 aa, Porcine reproductive and respiratory syndrome virus; identical to SEQ ID NO: 350

SEQ ID NO: 1158 - protein, 34 aa, Porcine reproductive and respiratory syndrome virus; identical to SEQ ID NO: 47

SEQ ID NO: 1159 - protein, 34 aa, Porcine reproductive and respiratory syndrome virus; identical to SEQ ID NO: 267

SEQ ID NO: 1160 - protein, 34 aa, Porcine reproductive and respiratory syndrome virus
LVNANNDSSSHLQLIYNLTICELNGTEWLNEHFS

SEQ ID NO: 1161 - protein, 34 aa, Porcine reproductive and respiratory syndrome virus; identical to SEQ ID NO: 475

SEQ ID NO: 1162 - protein, 34 aa, Porcine reproductive and respiratory syndrome virus
LVNADNNSSSHLQLIYNLTICELNGTDWLTTNFD

SEQ ID NO: 1163 - protein, 34 aa, Porcine reproductive and respiratory syndrome virus; identical to SEQ ID NO: 55

SEQ ID NO: 1164 - protein, 34 aa, Porcine reproductive and respiratory syndrome virus
LVNANSNSSSHLQLIYNLTICELNGTEWLSNHFS

SEQ ID NO: 1165 - protein, 34 aa, Porcine reproductive and respiratory syndrome virus
LVNANSNSSSHFQLIYNLTLCELNGTHWLANKFD

SEQ ID NO: 1166 - protein, 34 aa, Porcine reproductive and respiratory syndrome virus; identical to SEQ ID NO: 680

SEQ ID NO: 1167 - protein, 34 aa, Porcine reproductive and respiratory syndrome virus; identical to SEQ ID NO: 55

SEQ ID NO: 1168 - protein, 34 aa, Porcine reproductive and respiratory syndrome virus; identical to SEQ ID NO: 47

SEQ ID NO: 1169 - protein, 34 aa, Porcine reproductive and respiratory syndrome virus
  misc_feature (6)..(6): Xaa can be any naturally occurring amino acid
LANASXNSSSHLQLIYNLTLCELNGTDWLABKFD

SEQ ID NO: 1170 - protein, 34 aa, Porcine reproductive and respiratory syndrome virus; identical to SEQ ID NO: 61

SEQ ID NO: 1171 - protein, 34 aa, Porcine reproductive and respiratory syndrome virus
LVNAHSNSSSHLQLIYNLTICELNGTEWLDEHFS

SEQ ID NO: 1172 - protein, 34 aa, Porcine reproductive and respiratory syndrome virus; identical to SEQ ID NO: 44

SEQ ID NO: 1173 - protein, 34 aa, Porcine reproductive and respiratory syndrome virus; identical to SEQ ID NO: 481

SEQ ID NO: 1174 - protein, 34 aa, Porcine reproductive and respiratory syndrome virus; identical to SEQ ID NO: 473

SEQ ID NO: 1175 - protein, 34 aa, Porcine reproductive and respiratory syndrome virus
LVNASGNSSSHVQLIYNLTICELNGTDWLNNKFD

SEQ ID NO: 1176 - protein, 34 aa, Porcine reproductive and respiratory syndrome virus
LVNAEENHSSHLQLIYNLTLCELNGTDWLKNKFD

SEQ ID NO: 1177 - protein, 34 aa, Porcine reproductive and respiratory syndrome virus
LVNAGNNNSSHLQLIYNLTICELNGTDWLNKHFG

SEQ ID NO: 1178 - protein, 34 aa, Porcine reproductive and respiratory syndrome virus; identical to SEQ ID NO: 680

SEQ ID NO: 1179 - protein, 34 aa, Porcine reproductive and respiratory syndrome virus; identical to SEQ ID NO: 483

SEQ ID NO: 1180 - protein, 34 aa, Porcine reproductive and respiratory syndrome virus; identical to SEQ ID NO: 481

SEQ ID NO: 1181 - protein, 34 aa, Porcine reproductive and respiratory syndrome virus; identical to SEQ ID NO: 874

SEQ ID NO: 1182 - protein, 34 aa, Porcine reproductive and respiratory syndrome virus
LGNADSNSSSHLQLIYNLTICELNGTDWLNNHFS

SEQ ID NO: 1183 - protein, 34 aa, Porcine reproductive and respiratory syndrome virus
LVNAGNSSSSHLQLIYNLTLCELNGTDWLGNKFD

SEQ ID NO: 1184 - protein, 34 aa, Porcine reproductive and respiratory syndrome virus
LVNASNSSSSHLQLIYNLTICELNGTDWLNKSFD

SEQ ID NO: 1185 - protein, 34 aa, Porcine reproductive and respiratory syndrome virus; identical to SEQ ID NO: 475

SEQ ID NO: 1186 - protein, 34 aa, Porcine reproductive and respiratory syndrome virus; identical to SEQ ID NO: 962

SEQ ID NO: 1187 - protein, 34 aa, Porcine reproductive and respiratory syndrome virus; identical to SEQ ID NO: 48

SEQ ID NO: 1188 - protein, 34 aa, Porcine reproductive and respiratory syndrome virus
LVNANSNSSSHLQLIYNLTICELNGTDWLKNKFD

SEQ ID NO: 1189 - protein, 34 aa, Porcine reproductive and respiratory syndrome virus
LANASGNSSSHLQLIYNLTLCELNGTDWLRNKFD

SEQ ID NO: 1190 - protein, 34 aa, Porcine reproductive and respiratory syndrome virus
LVNADSNSSSHLQLIYNLTICELNGTDWLNEHFS

SEQ ID NO: 1191 - protein, 34 aa, Porcine reproductive and respiratory syndrome virus; identical to SEQ ID NO: 680

SEQ ID NO: 1192 - protein, 34 aa, Porcine reproductive and respiratory syndrome virus; identical to SEQ ID NO: 1151

SEQ ID NO: 1193 - protein, 34 aa, Porcine reproductive and respiratory syndrome virus
LVNASNNSSSHLQLIYNLTICELNGTEWLNDHFS

SEQ ID NO: 1194 - protein, 34 aa, Porcine reproductive and respiratory syndrome virus
IVNASNNSSSHLQLIYNLTICELNGTEWLNNHFS

SEQ ID NO: 1195 - protein, 34 aa, Porcine reproductive and respiratory syndrome virus; identical to SEQ ID NO: 1100

SEQ ID NO: 1196 - protein, 34 aa, Porcine reproductive and respiratory syndrome virus; identical to SEQ ID NO: 680

SEQ ID NO: 1197 - protein, 34 aa, Porcine reproductive and respiratory syndrome virus; identical to SEQ ID NO: 39

SEQ ID NO: 1198 - protein, 34 aa, Porcine reproductive and respiratory syndrome virus; identical to SEQ ID NO: 172

SEQ ID NO: 1199 - protein, 34 aa, Porcine reproductive and respiratory syndrome virus; identical to SEQ ID NO: 481

SEQ ID NO: 1200 - protein, 34 aa, Porcine reproductive and respiratory syndrome virus
IVNASSNSSSHFQLIYNLTLCELNGTDWLANHFD

SEQ ID NO: 1201 - protein, 34 aa, Porcine reproductive and respiratory syndrome virus; identical to SEQ ID NO: 686

SEQ ID NO: 1202 - protein, 34 aa, Porcine reproductive and respiratory syndrome virus
PVNADNSSSSYSQLIYNLTICELNGTDWLADKFN

SEQ ID NO: 1203 - protein, 34 aa, Porcine reproductive and respiratory syndrome virus; identical to SEQ ID NO: 680

SEQ ID NO: 1204 - protein, 34 aa, Porcine reproductive and respiratory syndrome virus; identical to SEQ ID NO: 1036

SEQ ID NO: 1205 - protein, 34 aa, Porcine reproductive and respiratory syndrome virus
LVNADGNSSSHFQLIYNLTICELNGTDWLNNHFS

SEQ ID NO: 1206 - protein, 34 aa, Porcine reproductive and respiratory syndrome virus; identical to SEQ ID NO: 55

SEQ ID NO: 1207 - protein, 34 aa, Porcine reproductive and respiratory syndrome virus
LVNANSNSSSHLQLIYNLTLCELNGTEWLAGRFD

SEQ ID NO: 1208 - protein, 34 aa, Porcine reproductive and respiratory syndrome virus; identical to SEQ ID NO: 918

SEQ ID NO: 1209 - protein, 34 aa, Porcine reproductive and respiratory syndrome virus
LVNANGNSSSHLQLIYNLTICELNGTDWLNSHFS

SEQ ID NO: 1210 - protein, 34 aa, Porcine reproductive and respiratory syndrome virus
LVNASSNSSSHFQLIYNLTICELNGTDWLNDHFS

SEQ ID NO: 1211 - protein, 34 aa, Porcine reproductive and respiratory syndrome virus
LVNASNNSSSHLQLIYNLTICELNGTDWLNDRFD

SEQ ID NO: 1212 - protein, 34 aa, Porcine reproductive and respiratory syndrome virus; identical to SEQ ID NO: 267

SEQ ID NO: 1213 - protein, 34 aa, Porcine reproductive and respiratory syndrome virus; identical to SEQ ID NO: 513

SEQ ID NO: 1214 - protein, 34 aa, Porcine reproductive and respiratory syndrome virus; identical to SEQ ID NO: 1029

SEQ ID NO: 1215 - protein, 34 aa, Porcine reproductive and respiratory syndrome virus
IVNANSSSSSHFQLIYNLTLCELNGTDWLASKFD

SEQ ID NO: 1216 - protein, 34 aa, Porcine reproductive and respiratory syndrome virus
LVNAKSNSSSHLQLIYNLTLCELNGTBWLKDKFD

SEQ ID NO: 1217 - protein, 34 aa, Porcine reproductive and respiratory syndrome virus; identical to SEQ ID NO: 75

SEQ ID NO: 1218 - protein, 34 aa, Porcine reproductive and respiratory syndrome virus
LVNASNNSSSHLQLIYNLTICELNGTDWLNGHFS

SEQ ID NO: 1219 - protein, 34 aa, Porcine reproductive and respiratory syndrome virus
  misc_feature (31)..(31): Xaa can be any naturally occurring amino acid
LVNASNNNSSHLQLIYNLTICELNGTDWLNXHFS

SEQ ID NO: 1220 - protein, 34 aa, Porcine reproductive and respiratory syndrome virus; identical to SEQ ID NO: 481

SEQ ID NO: 1221 - protein, 34 aa, Porcine reproductive and respiratory syndrome virus
LVNASNDSSSHLQLIYNLTICELNGTDWLNDKFD

SEQ ID NO: 1222 - protein, 34 aa, Porcine reproductive and respiratory syndrome virus
LVNASSNSSSHLQLIYNLTICELNGTDWLNTHFS

SEQ ID NO: 1223 - protein, 34 aa, Porcine reproductive and respiratory syndrome virus; identical to SEQ ID NO: 350

SEQ ID NO: 1224 - protein, 34 aa, Porcine reproductive and respiratory syndrome virus; identical to SEQ ID NO: 486

SEQ ID NO: 1225 - protein, 34 aa, Porcine reproductive and respiratory syndrome virus; identical to SEQ ID NO: 483

SEQ ID NO: 1226 - protein, 34 aa, Porcine reproductive and respiratory syndrome virus
LVNAKNNSSSHLQLIYNLTICELNGTDWLNKKFD

SEQ ID NO: 1227 - protein, 34 aa, Porcine reproductive and respiratory syndrome virus
LVNANGNSSSHLQLIYNLTICELNGTDWLNNHFS

SEQ ID NO: 1228 - protein, 34 aa, Porcine reproductive and respiratory syndrome virus
LVNANSNSSSHLQLIYNLTICELNGTDWLKNNFD

SEQ ID NO: 1229 - protein, 34 aa, Porcine reproductive and respiratory syndrome virus
LVNASSNSSSHLQLIYNLTICELNGTDWLNNHFN

SEQ ID NO: 1230 - protein, 34 aa, Porcine reproductive and respiratory syndrome virus; identical to SEQ ID NO: 499

SEQ ID NO: 1231 - protein, 34 aa, Porcine reproductive and respiratory syndrome virus
LVNANSNSSSHLQLIYNLTICELNGTDWLDRHFS

SEQ ID NO: 1232 - protein, 34 aa, Porcine reproductive and respiratory syndrome virus; identical to SEQ ID NO: 469

SEQ ID NO: 1233 - protein, 34 aa, Porcine reproductive and respiratory syndrome virus
IVNASSNSSSQFQLIYNLTICELNGTEWLANKFD

SEQ ID NO: 1234 - protein, 34 aa, Porcine reproductive and respiratory syndrome virus; identical to SEQ ID NO: 1207

SEQ ID NO: 1235 - protein, 34 aa, Porcine reproductive and respiratory syndrome virus; identical to SEQ ID NO: 560

SEQ ID NO: 1236 - protein, 34 aa, Porcine reproductive and respiratory syndrome virus
LVNASSNSSSHLQLIYNLTICELNGTDWLNGHFS

SEQ ID NO: 1237 - protein, 34 aa, Porcine reproductive and respiratory syndrome virus; identical to SEQ ID NO: 1040

SEQ ID NO: 1238 - protein, 34 aa, Porcine reproductive and respiratory syndrome virus; identical to SEQ ID NO: 996

SEQ ID NO: 1239 - protein, 34 aa, Porcine reproductive and respiratory syndrome virus; identical to SEQ ID NO: 39

SEQ ID NO: 1240 - protein, 34 aa, Porcine reproductive and respiratory syndrome virus; identical to SEQ ID NO: 1052

SEQ ID NO: 1241 - protein, 34 aa, Porcine reproductive and respiratory syndrome virus
IVNASSNSSSHFQLIYNLTLCELNGTDWLAEKFD

SEQ ID NO: 1242 - protein, 34 aa, Porcine reproductive and respiratory syndrome virus
LVNAHSNSSSHFQLIYNLTLCELNGTEWLGNKFD

SEQ ID NO: 1243 - protein, 34 aa, Porcine reproductive and respiratory syndrome virus
LVNASNNDSSHLQSIYNLTICELNGTDWLSNKFD

SEQ ID NO: 1244 - protein, 34 aa, Porcine reproductive and respiratory syndrome virus
LVNASNNSSSHFQLIYNLTICELNGTDWLNEHFS

SEQ ID NO: 1245 - protein, 34 aa, Porcine reproductive and respiratory syndrome virus; identical to SEQ ID NO: 696

SEQ ID NO: 1246 - protein, 34 aa, Porcine reproductive and respiratory syndrome virus
LVNADSNSSSHLQLIYNLTICELNGTDWLNSHFS

SEQ ID NO: 1247 - protein, 34 aa, Porcine reproductive and respiratory syndrome virus; identical to SEQ ID NO: 41

SEQ ID NO: 1248 - protein, 34 aa, Porcine reproductive and respiratory syndrome virus
LVNASNNSSSHLQLIYNLTICELNGTDWLBKHFS

SEQ ID NO: 1249 - protein, 34 aa, Porcine reproductive and respiratory syndrome virus
LVNANNNSSSHLQLIYNLTICELNGTDWLNSHFS

SEQ ID NO: 1250 - protein, 34 aa, Porcine reproductive and respiratory syndrome virus
LVNASNNSSSHLQSIYNLTICELNGTDWLNGHFS

SEQ ID NO: 1251 - protein, 34 aa, Porcine reproductive and respiratory syndrome virus
LVNANNSSSSHIQLIYNLTLCELNGTDWLANKFD

SEQ ID NO: 1252 - protein, 34 aa, Porcine reproductive and respiratory syndrome virus; identical to SEQ ID NO: 1121

SEQ ID NO: 1253 - protein, 34 aa, Porcine reproductive and respiratory syndrome virus
LVNASNNSSSHLQLIYNLTLCELNGTDWLANRFD

SEQ ID NO: 1254 - protein, 34 aa, Porcine reproductive and respiratory syndrome virus
LVNANSNSSSHFQLIYNLTLCELNGTDWLKGKFD

SEQ ID NO: 1255 - protein, 34 aa, Porcine reproductive and respiratory syndrome virus; identical to SEQ ID NO: 987

SEQ ID NO: 1256 - protein, 34 aa, Porcine reproductive and respiratory syndrome virus
LVNANRNNSSHLQLIYNLTLCELNGTDWLKNKFD

SEQ ID NO: 1257 - protein, 34 aa, Porcine reproductive and respiratory syndrome virus
LVNANSSSSSHLQLIYNLTLCELNGTDWLNNKFD

SEQ ID NO: 1258 - protein, 34 aa, Porcine reproductive and respiratory syndrome virus
LVNANSNSSSHFQLIYNLTICELNGTEWLSNHFS

SEQ ID NO: 1259 - protein, 34 aa, Porcine reproductive and respiratory syndrome virus; identical to SEQ ID NO: 493

SEQ ID NO: 1260 - protein, 34 aa, Porcine reproductive and respiratory syndrome virus
LVNASSNSSSHLQLIYNLTICELNGTDWLDNRFS

SEQ ID NO: 1261 - protein, 34 aa, Porcine reproductive and respiratory syndrome virus
  misc_feature (31)..(31): Xaa can be any naturally occurring amino acid
LVNASNNSSSHLQLIYNLTICELNGTDWLNXHFS

SEQ ID NO: 1262 - protein, 34 aa, Porcine reproductive and respiratory syndrome virus; identical to SEQ ID NO: 680

SEQ ID NO: 1263 - protein, 34 aa, Porcine reproductive and respiratory syndrome virus; identical to SEQ ID NO: 918

SEQ ID NO: 1264 - protein, 34 aa, Porcine reproductive and respiratory syndrome virus
IVNASSNSSSHLQLIYNLTICELNGTDWLNNHFS

SEQ ID NO: 1265 - protein, 34 aa, Porcine reproductive and respiratory syndrome virus
LVNANSNSSSHLQSIYNLTICELNGTDWLNDHFS

SEQ ID NO: 1266 - protein, 34 aa, Porcine reproductive and respiratory syndrome virus
LVNASSNSSSHLQLIYNLTICELNGTDWLKDHFS

SEQ ID NO: 1267 - protein, 34 aa, Porcine reproductive and respiratory syndrome virus; identical to SEQ ID NO: 918

SEQ ID NO: 1268 - protein, 34 aa, Porcine reproductive and respiratory syndrome virus
LVNANSSSGSHLQLIYNLTLCELNGTDWLGNKFD

SEQ ID NO: 1269 - protein, 34 aa, Porcine reproductive and respiratory syndrome virus
LVNANSSNSSHLQLIYNLTICELNGTDWLDNHFS

SEQ ID NO: 1270 - protein, 34 aa, Porcine reproductive and respiratory syndrome virus
LVNASNNNSSHLQLIYNLTICELNGTDWLDGHFS

SEQ ID NO: 1271 - protein, 34 aa, Porcine reproductive and respiratory syndrome virus
LVNASSNSSSHLQLIYNLTICELNGTDWLNSHFS

SEQ ID NO: 1272 - protein, 34 aa, Porcine reproductive and respiratory syndrome virus; identical to SEQ ID NO: 680

SEQ ID NO: 1273 - protein, 34 aa, Porcine reproductive and respiratory syndrome virus
LVNASNSSSSHLQLIYNLTICELNGTDWLDSHFS

SEQ ID NO: 1274 - protein, 34 aa, Porcine reproductive and respiratory syndrome virus
LVNANSNSSSHFQLIYNLTLCELNGTEWLSNRFD

SEQ ID NO: 1275 - protein, 34 aa, Porcine reproductive and respiratory syndrome virus; identical to SEQ ID NO: 188

SEQ ID NO: 1276 - protein, 34 aa, Porcine reproductive and respiratory syndrome virus; identical to SEQ ID NO: 680

SEQ ID NO: 1277 - protein, 34 aa, Porcine reproductive and respiratory syndrome virus
LVNADSNNSSHLQSIYNLTICELNGTDWLNNKFD

SEQ ID NO: 1278 - protein, 34 aa, Porcine reproductive and respiratory syndrome virus; identical to SEQ ID NO: 878

SEQ ID NO: 1279 - protein, 34 aa, Porcine reproductive and respiratory syndrome virus; identical to SEQ ID NO: 1265

SEQ ID NO: 1280 - protein, 34 aa, Porcine reproductive and respiratory syndrome virus
LVNASSNNSSHLQLIYNLTICELNGTDWLDNHFS

SEQ ID NO: 1281 - protein, 34 aa, Porcine reproductive and respiratory syndrome virus
LANASENSSSHLQLIYNLTLCELNGTDWLKNKFD

SEQ ID NO: 1282 - protein, 34 aa, Porcine reproductive and respiratory syndrome virus; identical to SEQ ID NO: 267

SEQ ID NO: 1283 - protein, 34 aa, Porcine reproductive and respiratory syndrome virus
LVNATSNSSSHLQLIYNLTLCELNGTDWLKDKFD

SEQ ID NO: 1284 - protein, 34 aa, Porcine reproductive and respiratory syndrome virus
LANAHSGNSSHLQLIYNLTICELNGTDWLNNHFS

SEQ ID NO: 1285 - protein, 34 aa, Porcine reproductive and respiratory syndrome virus; identical to SEQ ID NO: 475

SEQ ID NO: 1286 - protein, 34 aa, Porcine reproductive and respiratory syndrome virus; identical to SEQ ID NO: 1049

SEQ ID NO: 1287 - protein, 34 aa, Porcine reproductive and respiratory syndrome virus
IVNANSNSSSQFQLIYNLTICELNGTDWLANKFD

SEQ ID NO: 1288 - protein, 34 aa, Porcine reproductive and respiratory syndrome virus
LVNASSNNSSHLQLIYNLTICELNGTDWLDRHFG

SEQ ID NO: 1289 - protein, 34 aa, Porcine reproductive and respiratory syndrome virus; identical to SEQ ID NO: 720

SEQ ID NO: 1290 - protein, 34 aa, Porcine reproductive and respiratory syndrome virus; identical to SEQ ID NO: 267

SEQ ID NO: 1291 - protein, 34 aa, Porcine reproductive and respiratory syndrome virus
LVNASNSSSSHLQLIYNLTICELNGTDWLNNHFS

SEQ ID NO: 1292 - protein, 34 aa, Porcine reproductive and respiratory syndrome virus
LVNADSNSSSHLQLIYNLTICELNGTEWLNEHFS

SEQ ID NO: 1293 - protein, 34 aa, Porcine reproductive and respiratory syndrome virus
LVNANNDSSSHLQLIYNLTICELNGTDWLNKHFS

SEQ ID NO: 1294 - protein, 34 aa, Porcine reproductive and respiratory syndrome virus; identical to SEQ ID NO: 484

SEQ ID NO: 1295 - protein, 34 aa, Porcine reproductive and respiratory syndrome virus
LVNASSNSSSHLQLIYNLTICELNGTDWLNEHFS

SEQ ID NO: 1296 - protein, 34 aa, Porcine reproductive and respiratory syndrome virus
  misc_feature (14)..(14): Xaa can be any naturally occurring amino acid
LVNANSNSSSHLQXIYNLTICELNGTDWLNNHFS

SEQ ID NO: 1297 - protein, 34 aa, Porcine reproductive and respiratory syndrome virus
LVNAGNNNSSHLQLIYNLTICELNGTDWLNRHFS

SEQ ID NO: 1298 - protein, 34 aa, Porcine reproductive and respiratory syndrome virus
LVNASNGSSSNLQLIYNLTICELNGTDWLNDHFS

SEQ ID NO: 1299 - protein, 34 aa, Porcine reproductive and respiratory syndrome virus
LVNAGGNSSSHFQLIYNLTICELNGTDWLNDHFS

SEQ ID NO: 1300 - protein, 34 aa, Porcine reproductive and respiratory syndrome virus; identical to SEQ ID NO: 1299

SEQ ID NO: 1301 - protein, 34 aa, Porcine reproductive and respiratory syndrome virus
LVNANSNNSSHLQLIYNLTICELNGTDWLNEHFS

SEQ ID NO: 1302 - protein, 34 aa, Porcine reproductive and respiratory syndrome virus
LVNANNYSSSHLQLIYNLTICELNGTDWLNNHFS

SEQ ID NO: 1303 - protein, 34 aa, Porcine reproductive and respiratory syndrome virus; identical to SEQ ID NO: 1135

SEQ ID NO: 1304 - protein, 34 aa, Porcine reproductive and respiratory syndrome virus; identical to SEQ ID NO: 1026

SEQ ID NO: 1305 - protein, 34 aa, Porcine reproductive and respiratory syndrome virus
LVNASTNSSSHLQLIYNLTICELNGTEWLNNHFS

SEQ ID NO: 1306 - protein, 34 aa, Porcine reproductive and respiratory syndrome virus; identical to SEQ ID NO: 487

SEQ ID NO: 1307 - protein, 34 aa, Porcine reproductive and respiratory syndrome virus; identical to SEQ ID NO: 987

SEQ ID NO: 1308 - protein, 34 aa, Porcine reproductive and respiratory syndrome virus
LVNANSNSSSHLQLIYNLTICELNGTHWLYEHFS

SEQ ID NO: 1309 - protein, 34 aa, Porcine reproductive and respiratory syndrome virus
  misc_feature (27)..(27): Xaa can be any naturally occurring amino acid
LVNAGSNSSSHLQLIYNLTICELNGTXWLNNHFS

SEQ ID NO: 1310 - protein, 34 aa, Porcine reproductive and respiratory syndrome virus
LVNADSNNSSHLQLIYNLTICELNGTDWLDEHFS

SEQ ID NO: 1311 - protein, 34 aa, Porcine reproductive and respiratory syndrome virus
IVNASSNSSSHIQLIYNLTICELNGTDWLNHKFD

SEQ ID NO: 1312 - protein, 34 aa, Porcine reproductive and respiratory syndrome virus
LVNANSNSSSHLQLIYNLTICELNGTDWLYEHFS

SEQ ID NO: 1313 - protein, 34 aa, Porcine reproductive and respiratory syndrome virus
PANANNGSSSHLQLIYNLTLCELNGTDWLADKFD

SEQ ID NO: 1314 - protein, 34 aa, Porcine reproductive and respiratory syndrome virus; identical to SEQ ID NO: 178

SEQ ID NO: 1315 - protein, 34 aa, Porcine reproductive and respiratory syndrome virus
LVNADSNSSSHFQLIYNLTLCELNGTDWLAKNFD

SEQ ID NO: 1316 - protein, 34 aa, Porcine reproductive and respiratory syndrome virus
LANASDNSSSHLQLIYNLTLCELNGTDWLADKFD

SEQ ID NO: 1317 - protein, 34 aa, Porcine reproductive and respiratory syndrome virus; identical to SEQ ID NO: 1141

SEQ ID NO: 1318 - protein, 34 aa, Porcine reproductive and respiratory syndrome virus
FANASGNSSSHLQLIYNLTLCELNGTDWLANKFD

SEQ ID NO: 1319 - protein, 34 aa, Porcine reproductive and respiratory syndrome virus; identical to SEQ ID NO: 47

SEQ ID NO: 1320 - protein, 34 aa, Porcine reproductive and respiratory syndrome virus; identical to SEQ ID NO: 39

SEQ ID NO: 1321 - protein, 34 aa, Porcine reproductive and respiratory syndrome virus
  misc_feature (10)..(10): Xaa can be any naturally occurring amino acid
LVNANSNSSXHFQLIYNLTLCELNGTDWLANKFD

SEQ ID NO: 1322 - protein, 34 aa, Porcine reproductive and respiratory syndrome virus
LANASDNSSSHLQLIYNLTLCELNGTDWLANRFD

SEQ ID NO: 1323 - protein, 34 aa, Porcine reproductive and respiratory syndrome virus; identical to SEQ ID NO: 61

SEQ ID NO: 1324 - protein, 34 aa, Porcine reproductive and respiratory syndrome virus
LVNASSNSSSHLQLIYNLTLCELNGTDWLANKFD

SEQ ID NO: 1325 - protein, 34 aa, Porcine reproductive and respiratory syndrome virus; identical to SEQ ID NO: 256

SEQ ID NO: 1326 - protein, 34 aa, Porcine reproductive and respiratory syndrome virus; identical to SEQ ID NO: 47

SEQ ID NO: 1327 - protein, 34 aa, Porcine reproductive and respiratory syndrome virus; identical to SEQ ID NO: 564

SEQ ID NO: 1328 - protein, 34 aa, Porcine reproductive and respiratory syndrome virus
LVNANSNSSSHFQLIYNLTLCELNGTDWLANNFN

SEQ ID NO: 1329 - protein, 34 aa, Porcine reproductive and respiratory syndrome virus; identical to SEQ ID NO: 1056

SEQ ID NO: 1330 - protein, 34 aa, Porcine reproductive and respiratory syndrome virus
LVNATSNSSSHFQLIYNLTLCELNGTDWLAGKFN

SEQ ID NO: 1331 - protein, 34 aa, Porcine reproductive and respiratory syndrome virus; identical to SEQ ID NO: 236

SEQ ID NO: 1332 - protein, 34 aa, Porcine reproductive and respiratory syndrome virus; identical to SEQ ID NO: 564

SEQ ID NO: 1333 - protein, 34 aa, Porcine reproductive and respiratory syndrome virus; identical to SEQ ID NO: 1316

SEQ ID NO: 1334 - protein, 34 aa, Porcine reproductive and respiratory syndrome virus
LANADSNSSSHFQLIYNLTLCELNGTDWLNKKFD

SEQ ID NO: 1335 - protein, 34 aa, Porcine reproductive and respiratory syndrome virus
LVNANSTSSSHFQLIYNLTLCELNGTDWLADKFD

SEQ ID NO: 1336 - protein, 34 aa, Porcine reproductive and respiratory syndrome virus
LVNANSNSSSHLQLIYNLTLCELNGTDWLGKQFD

SEQ ID NO: 1337 - protein, 34 aa, Porcine reproductive and respiratory syndrome virus
LANASNNSSSHLQLIYNLTLCELNGTDWLANQFD

SEQ ID NO: 1338 - protein, 34 aa, Porcine reproductive and respiratory syndrome virus; identical to SEQ ID NO: 765

SEQ ID NO: 1339 - protein, 34 aa, Porcine reproductive and respiratory syndrome virus
LVNANSSSSSHFQLIYNLTICELNGTDWLDNKFD

SEQ ID NO: 1340 - protein, 34 aa, Porcine reproductive and respiratory syndrome virus; identical to SEQ ID NO: 39

SEQ ID NO: 1341 - protein, 34 aa, Porcine reproductive and respiratory syndrome virus; identical to SEQ ID NO: 55

SEQ ID NO: 1342 - protein, 34 aa, Porcine reproductive and respiratory syndrome virus; identical to SEQ ID NO: 178

SEQ ID NO: 1343 - protein, 34 aa, Porcine reproductive and respiratory syndrome virus; identical to SEQ ID NO: 542

SEQ ID NO: 1344 - protein, 34 aa, Porcine reproductive and respiratory syndrome virus; identical to SEQ ID NO: 542

SEQ ID NO: 1345 - protein, 34 aa, Porcine reproductive and respiratory syndrome virus
IVNAGSNSSSHFQLIYNLTLCELNGTDWLANKFD

SEQ ID NO: 1346 - protein, 34 aa, Porcine reproductive and respiratory syndrome virus; identical to SEQ ID NO: 55

SEQ ID NO: 1347 - protein, 34 aa, Porcine reproductive and respiratory syndrome virus
LVNASNDNSSHLQLIYNLTLCELNGTDWLANKFD

SEQ ID NO: 1348 - protein, 34 aa, Porcine reproductive and respiratory syndrome virus
LANASGNSSSHLQLIYNLTLCELNGTDWLANRFD

SEQ ID NO: 1349 - protein, 34 aa, Porcine reproductive and respiratory syndrome virus; identical to SEQ ID NO: 41

SEQ ID NO: 1350 - protein, 34 aa, Porcine reproductive and respiratory syndrome virus
PANANSNSSSHLQLIYNLTLCELNGTDWLANKFD

SEQ ID NO: 1351 - protein, 34 aa, Porcine reproductive and respiratory syndrome virus; identical to SEQ ID NO: 1350

SEQ ID NO: 1352 - protein, 34 aa, Porcine reproductive and respiratory syndrome virus; identical to SEQ ID NO: 39

SEQ ID NO: 1353 - protein, 34 aa, Porcine reproductive and respiratory syndrome virus; identical to SEQ ID NO: 595

SEQ ID NO: 1354 - protein, 34 aa, Porcine reproductive and respiratory syndrome virus; identical to SEQ ID NO: 55

SEQ ID NO: 1355 - protein, 34 aa, Porcine reproductive and respiratory syndrome virus; identical to SEQ ID NO: 183

SEQ ID NO: 1356 - protein, 34 aa, Porcine reproductive and respiratory syndrome virus
IVNASSNSSSHFQLIYNLTLCELNGTEWLANKFD

SEQ ID NO: 1357 - protein, 34 aa, Porcine reproductive and respiratory syndrome virus; identical to SEQ ID NO: 41

SEQ ID NO: 1358 - protein, 34 aa, Porcine reproductive and respiratory syndrome virus; identical to SEQ ID NO: 41

SEQ ID NO: 1359 - protein, 34 aa, Porcine reproductive and respiratory syndrome virus; identical to SEQ ID NO: 41

SEQ ID NO: 1360 - protein, 34 aa, Porcine reproductive and respiratory syndrome virus
  misc_feature (5)..(5): Xaa can be any naturally occurring amino acid
LVNAXSSSSSHFQLIYNLTLCELNGTDWLAEKFD

SEQ ID NO: 1361 - protein, 34 aa, Porcine reproductive and respiratory syndrome virus; identical to SEQ ID NO: 47

SEQ ID NO: 1362 - protein, 34 aa, Porcine reproductive and respiratory syndrome virus; identical to SEQ ID NO: 66

SEQ ID NO: 1363 - protein, 34 aa, Porcine reproductive and respiratory syndrome virus; identical to SEQ ID NO: 47

SEQ ID NO: 1364 - protein, 34 aa, Porcine reproductive and respiratory syndrome virus; identical to SEQ ID NO: 47

SEQ ID NO: 1365 - protein, 34 aa, Porcine reproductive and respiratory syndrome virus
LVNANSNNSSHLQLIYNLTLCSLNGTDWLANKFD

SEQ ID NO: 1366 - protein, 34 aa, Porcine reproductive and respiratory syndrome virus; identical to SEQ ID NO: 542

SEQ ID NO: 1367 - protein, 34 aa, Porcine reproductive and respiratory syndrome virus; identical to SEQ ID NO: 464

SEQ ID NO: 1368 - protein, 34 aa, Porcine reproductive and respiratory syndrome virus; identical to SEQ ID NO: 47

SEQ ID NO: 1369 - protein, 34 aa, Porcine reproductive and respiratory syndrome virus
LVNADSTSSSHFQLIYNLTLCELNGTDWLSDKFD

SEQ ID NO: 1370 - protein, 34 aa, Porcine reproductive and respiratory syndrome virus; identical to SEQ ID NO: 992

SEQ ID NO: 1371 - protein, 34 aa, Porcine reproductive and respiratory syndrome virus; identical to SEQ ID NO: 47

SEQ ID NO: 1372 - protein, 34 aa, Porcine reproductive and respiratory syndrome virus; identical to SEQ ID NO: 64

SEQ ID NO: 1373 - protein, 34 aa, Porcine reproductive and respiratory syndrome virus; identical to SEQ ID NO: 47

SEQ ID NO: 1374 - protein, 34 aa, Porcine reproductive and respiratory syndrome virus
LVNASSNSSSHLQLIYNLTICELNGTDWLNHKFD

SEQ ID NO: 1375 - protein, 34 aa, Porcine reproductive and respiratory syndrome virus; identical to SEQ ID NO: 544

SEQ ID NO: 1376 - protein, 34 aa, Porcine reproductive and respiratory syndrome virus
IVNASSNSSSHFQLIYNLTLCELNGTDWLANKFN

SEQ ID NO: 1377 - protein, 34 aa, Porcine reproductive and respiratory syndrome virus
LVNASSNSSSHFQLIYNLTLCELNGTDWLAGKFD

SEQ ID NO: 1378 - protein, 34 aa, Porcine reproductive and respiratory syndrome virus
LVNASDNSSSHLQLIYNLTLCELNGTDWLANKFD

SEQ ID NO: 1379 - protein, 34 aa, Porcine reproductive and respiratory syndrome virus
LVDANSNSSSHFQLIYNLTLCELNGTDWLKDHFN

SEQ ID NO: 1380 - protein, 34 aa, Porcine reproductive and respiratory syndrome virus; identical to SEQ ID NO: 992

SEQ ID NO: 1381 - protein, 34 aa, Porcine reproductive and respiratory syndrome virus; identical to SEQ ID NO: 1063

SEQ ID NO: 1382 - protein, 34 aa, Porcine reproductive and respiratory syndrome virus
LVNANSNSSSHFQLIYNLTLCELNGTDWLAENFD

SEQ ID NO: 1383 - protein, 34 aa, Porcine reproductive and respiratory syndrome virus
LVDANSNSSSHLQLIYNLTLCELNGTDWLKDHFN

SEQ ID NO: 1384 - protein, 34 aa, Porcine reproductive and respiratory syndrome virus; identical to SEQ ID NO: 55

SEQ ID NO: 1385 - protein, 34 aa, Porcine reproductive and respiratory syndrome virus; identical to SEQ ID NO: 1316

SEQ ID NO: 1386 - protein, 34 aa, Porcine reproductive and respiratory syndrome virus
LANASADSSSHLQLIYNLTLCELNGTDWLANKFD

SEQ ID NO: 1387 - protein, 34 aa, Porcine reproductive and respiratory syndrome virus; identical to SEQ ID NO: 560

SEQ ID NO: 1388 - protein, 34 aa, Porcine reproductive and respiratory syndrome virus; identical to SEQ ID NO: 560

SEQ ID NO: 1389 - protein, 34 aa, Porcine reproductive and respiratory syndrome virus
LVNANSNSSSHFQLIYNLTLCELNGTDWLAKSFD

SEQ ID NO: 1390 - protein, 34 aa, Porcine reproductive and respiratory syndrome virus; identical to SEQ ID NO: 47

SEQ ID NO: 1391 - protein, 34 aa, Porcine reproductive and respiratory syndrome virus
LVNANSNSSSHFQLIYNLTLCELNGTEWLAEKFD

SEQ ID NO: 1392 - protein, 34 aa, Porcine reproductive and respiratory syndrome virus
LVNAHSNSSSQFQLIYNLTLCELNGTDWLANKFD

SEQ ID NO: 1393 - protein, 34 aa, Porcine reproductive and respiratory syndrome virus; identical to SEQ ID NO: 1389

SEQ ID NO: 1394 - protein, 34 aa, Porcine reproductive and respiratory syndrome virus; identical to SEQ ID NO: 93

SEQ ID NO: 1395 - protein, 34 aa, Porcine reproductive and respiratory syndrome virus; identical to SEQ ID NO: 484

SEQ ID NO: 1396 - protein, 34 aa, Porcine reproductive and respiratory syndrome virus; identical to SEQ ID NO: 93

SEQ ID NO: 1397 - protein, 34 aa, Porcine reproductive and respiratory syndrome virus; identical to SEQ ID NO: 565

SEQ ID NO: 1398 - protein, 34 aa, Porcine reproductive and respiratory syndrome virus
LVNANSNSSSHFQLIYNLTLCELNGTDWLNEKFD

SEQ ID NO: 1399 - protein, 34 aa, Porcine reproductive and respiratory syndrome virus; identical to SEQ ID NO: 544

SEQ ID NO: 1400 - protein, 34 aa, Porcine reproductive and respiratory syndrome virus; identical to SEQ ID NO: 45

SEQ ID NO: 1401 - protein, 34 aa, Porcine reproductive and respiratory syndrome virus; identical to SEQ ID NO: 546

SEQ ID NO: 1402 - protein, 34 aa, Porcine reproductive and respiratory syndrome virus; identical to SEQ ID NO: 66

SEQ ID NO: 1403 - protein, 34 aa, Porcine reproductive and respiratory syndrome virus; identical to SEQ ID NO: 655

SEQ ID NO: 1404 - protein, 34 aa, Porcine reproductive and respiratory syndrome virus
LVDANSNSSSHFQLIYNLTLCELNGTDWLKNHFN

SEQ ID NO: 1405 - protein, 34 aa, Porcine reproductive and respiratory syndrome virus; identical to SEQ ID NO: 47

SEQ ID NO: 1406 - protein, 34 aa, Porcine reproductive and respiratory syndrome virus
IVNANSNSSSHFQLIYNLTICELNGTDWLNGKFD

SEQ ID NO: 1407 - protein, 34 aa, Porcine reproductive and respiratory syndrome virus; identical to SEQ ID NO: 172

SEQ ID NO: 1408 - protein, 34 aa, Porcine reproductive and respiratory syndrome virus; identical to SEQ ID NO: 1063

SEQ ID NO: 1409 - protein, 34 aa, Porcine reproductive and respiratory syndrome virus
LVNASSNSSSHFQLIYNLTLCELNGTEWLSNKFD

SEQ ID NO: 1410 - protein, 34 aa, Porcine reproductive and respiratory syndrome virus; identical to SEQ ID NO: 172

SEQ ID NO: 1411 - protein, 34 aa, Porcine reproductive and respiratory syndrome virus; identical to SEQ ID NO: 544

SEQ ID NO: 1412 - protein, 34 aa, Porcine reproductive and respiratory syndrome virus
IVNANSNSSSHLQLIYNLTLCELNGTDWLGSRFD

SEQ ID NO: 1413 - protein, 34 aa, Porcine reproductive and respiratory syndrome virus
  misc_feature (14)..(14): Xaa can be any naturally occurring amino acid
IVNASSNNSSHFQXIYNLTLCELNGTDWLANKFD

SEQ ID NO: 1414 - protein, 34 aa, Porcine reproductive and respiratory syndrome virus
IVNASSNNSSHFQSIYNLTLCELNGTDWLANKFD

SEQ ID NO: 1415 - protein, 34 aa, Porcine reproductive and respiratory syndrome virus
IVNASSNSSSHFQLIYNLTLCELNGTEWLVNKFD

SEQ ID NO: 1416 - protein, 34 aa, Porcine reproductive and respiratory syndrome virus
LVNANSASSSHFQLIYNLTLCELNGTDWLAGKFD

SEQ ID NO: 1417 - protein, 34 aa, Porcine reproductive and respiratory syndrome virus
LVNASTNSSSHFQLIYNLTLCELNGTDWLAEKFD

SEQ ID NO: 1418 - protein, 34 aa, Porcine reproductive and respiratory syndrome virus
IVNANSNSSSHFQLIYNLTICELNGTDWLNEKFD

SEQ ID NO: 1419 - protein, 34 aa, Porcine reproductive and respiratory syndrome virus
IVNANSNSSSHFQLIYNLTLCELNGTDWLADKFD

SEQ ID NO: 1420 - protein, 34 aa, Porcine reproductive and respiratory syndrome virus
LVNANSNNSSHFQLIYNLTLCELNGTDWLANKFD

SEQ ID NO: 1421 - protein, 34 aa, Porcine reproductive and respiratory syndrome virus; identical to SEQ ID NO: 47

SEQ ID NO: 1422 - protein, 34 aa, Porcine reproductive and respiratory syndrome virus; identical to SEQ ID NO: 626

SEQ ID NO: 1423 - protein, 34 aa, Porcine reproductive and respiratory syndrome virus
LVNANSNSSSHFQLIYNLTLCELNGTEWLADRFD

SEQ ID NO: 1424 - protein, 34 aa, Porcine reproductive and respiratory syndrome virus; identical to SEQ ID NO: 626

SEQ ID NO: 1425 - protein, 34 aa, Porcine reproductive and respiratory syndrome virus; identical to SEQ ID NO: 55

SEQ ID NO: 1426 - protein, 34 aa, Porcine reproductive and respiratory syndrome virus
IVNANSNSSSHFQLIYNLTLCELNGTEWLADKFD

SEQ ID NO: 1427 - protein, 34 aa, Porcine reproductive and respiratory syndrome virus; identical to SEQ ID NO: 1142

SEQ ID NO: 1428 - protein, 34 aa, Porcine reproductive and respiratory syndrome virus
PVNANGNSSSKLQLIYNLTLCELNGTDWLANRFD

SEQ ID NO: 1429 - protein, 34 aa, Porcine reproductive and respiratory syndrome virus
LVNANSSSSSHFQLIYNLTLCELNGTDWLRNKFD

SEQ ID NO: 1430 - protein, 34 aa, Porcine reproductive and respiratory syndrome virus
LVNANSNSSSHFQLIYNLTLCELNGTDWLNGKFD

SEQ ID NO: 1431 - protein, 34 aa, Porcine reproductive and respiratory syndrome virus
LVNANSNSSSHFQLIYNLTLCELNGTDWLANKFE

SEQ ID NO: 1432 - protein, 34 aa, Porcine reproductive and respiratory syndrome virus
IANASNBSSSHLQLIYNLTLCELNGTDWLANKFD

SEQ ID NO: 1433 - protein, 34 aa, Porcine reproductive and respiratory syndrome virus
IVNANSNSSSHFQLIYNLTICELNGTDWLNNNFD

SEQ ID NO: 1434 - protein, 34 aa, Porcine reproductive and respiratory syndrome virus; identical to SEQ ID NO: 596

SEQ ID NO: 1435 - protein, 34 aa, Porcine reproductive and respiratory syndrome virus; identical to SEQ ID NO: 55

SEQ ID NO: 1436 - protein, 34 aa, Porcine reproductive and respiratory syndrome virus; identical to SEQ ID NO: 686

SEQ ID NO: 1437 - protein, 34 aa, Porcine reproductive and respiratory syndrome virus; identical to SEQ ID NO: 759

SEQ ID NO: 1438 - protein, 34 aa, Porcine reproductive and respiratory syndrome virus
LVNANNSSSSHLQLIYNLTLCELNGTEWLANKFD

SEQ ID NO: 1439 - protein, 34 aa, Porcine reproductive and respiratory syndrome virus
LVNASTNSSSHFQLIYNLTLCELNGTDWLAKKFD

SEQ ID NO: 1440 - protein, 34 aa, Porcine reproductive and respiratory syndrome virus; identical to SEQ ID NO: 617

SEQ ID NO: 1441 - protein, 34 aa, Porcine reproductive and respiratory syndrome virus; identical to SEQ ID NO: 49

SEQ ID NO: 1442 - protein, 34 aa, Porcine reproductive and respiratory syndrome virus; identical to SEQ ID NO: 49

SEQ ID NO: 1443 - protein, 34 aa, Porcine reproductive and respiratory syndrome virus; identical to SEQ ID NO: 49

SEQ ID NO: 1444 - protein, 34 aa, Porcine reproductive and respiratory syndrome virus; identical to SEQ ID NO: 49

SEQ ID NO: 1445 - protein, 34 aa, Porcine reproductive and respiratory syndrome virus; identical to SEQ ID NO: 1379

SEQ ID NO: 1446 - protein, 34 aa, Porcine reproductive and respiratory syndrome virus; identical to SEQ ID NO: 737

SEQ ID NO: 1447 - protein, 34 aa, Porcine reproductive and respiratory syndrome virus; identical to SEQ ID NO: 1376

SEQ ID NO: 1448 - protein, 34 aa, Porcine reproductive and respiratory syndrome virus; identical to SEQ ID NO: 55

SEQ ID NO: 1449 - protein, 34 aa, Porcine reproductive and respiratory syndrome virus; identical to SEQ ID NO: 55

SEQ ID NO: 1450 - protein, 34 aa, Porcine reproductive and respiratory syndrome virus; identical to SEQ ID NO: 1377

SEQ ID NO: 1451 - protein, 34 aa, Porcine reproductive and respiratory syndrome virus
LVNASSNSSSHFQLIYNLTLCELNGTDWLNNKFD

SEQ ID NO: 1452 - protein, 34 aa, Porcine reproductive and respiratory syndrome virus; identical to SEQ ID NO: 47

SEQ ID NO: 1453 - protein, 34 aa, Porcine reproductive and respiratory syndrome virus
LVNANSSSSSHIQLIYNLTLCELNGTDWLTNKFD

SEQ ID NO: 1454 - protein, 34 aa, Porcine reproductive and respiratory syndrome virus; identical to SEQ ID NO: 469

SEQ ID NO: 1455 - protein, 34 aa, Porcine reproductive and respiratory syndrome virus
LVNANSNSSSHLQLIYNLTICELNGTDWLKDKFE

SEQ ID NO: 1456 - protein, 34 aa, Porcine reproductive and respiratory syndrome virus
LVNANSNSSSHLQLIYNLTLCELNGTDWLASKFD

SEQ ID NO: 1457 - protein, 34 aa, Porcine reproductive and respiratory syndrome virus
LVNAGNSSSSHLQLIYNLTLCELNGTDWLANKFD

SEQ ID NO: 1458 - protein, 34 aa, Porcine reproductive and respiratory syndrome virus; identical to SEQ ID NO: 43

SEQ ID NO: 1459 - protein, 34 aa, Porcine reproductive and respiratory syndrome virus
LVNANSNSSSHIQLIYNLTLCELNGTDWLAENFD

SEQ ID NO: 1460 - protein, 34 aa, Porcine reproductive and respiratory syndrome virus; identical to SEQ ID NO: 47

SEQ ID NO: 1461 - protein, 34 aa, Porcine reproductive and respiratory syndrome virus; identical to SEQ ID NO: 47

SEQ ID NO: 1462 - protein, 34 aa, Porcine reproductive and respiratory syndrome virus; identical to SEQ ID NO: 47

SEQ ID NO: 1463 - protein, 34 aa, Porcine reproductive and respiratory syndrome virus; identical to SEQ ID NO: 64

SEQ ID NO: 1464 - protein, 34 aa, Porcine reproductive and respiratory syndrome virus; identical to SEQ ID NO: 47

SEQ ID NO: 1465 - protein, 34 aa, Porcine reproductive and respiratory syndrome virus; identical to SEQ ID NO: 484

SEQ ID NO: 1466 - protein, 34 aa, Porcine reproductive and respiratory syndrome virus
LANASDNSSSHLQLIYNLTLCELNGTDWLTNKFD

SEQ ID NO: 1467 - protein, 34 aa, Porcine reproductive and respiratory syndrome virus; identical to SEQ ID NO: 55

SEQ ID NO: 1468 - protein, 34 aa, Porcine reproductive and respiratory syndrome virus; identical to SEQ ID NO: 236

SEQ ID NO: 1469 - protein, 34 aa, Porcine reproductive and respiratory syndrome virus
PANASNDSSSHLQLIYNLTLCELNGTDWLAKKFD

SEQ ID NO: 1470 - protein, 34 aa, Porcine reproductive and respiratory syndrome virus
LANASNNSSSHLQLIYNLTLCELNGTDWLAKKFD

SEQ ID NO: 1471 - protein, 34 aa, Porcine reproductive and respiratory syndrome virus
LVNANSSSSSHFQLIYNLTLCELNGTDWLASKFD

SEQ ID NO: 1472 - protein, 34 aa, Porcine reproductive and respiratory syndrome virus; identical to SEQ ID NO: 39

SEQ ID NO: 1473 - protein, 34 aa, Porcine reproductive and respiratory syndrome virus; identical to SEQ ID NO: 502

SEQ ID NO: 1474 - protein, 34 aa, Porcine reproductive and respiratory syndrome virus; identical to SEQ ID NO: 655

SEQ ID NO: 1475 - protein, 34 aa, Porcine reproductive and respiratory syndrome virus; identical to SEQ ID NO: 560

SEQ ID NO: 1476 - protein, 34 aa, Porcine reproductive and respiratory syndrome virus; identical to SEQ ID NO: 572

SEQ ID NO: 1477 - protein, 34 aa, Porcine reproductive and respiratory syndrome virus; identical to SEQ ID NO: 47

SEQ ID NO: 1478 - protein, 34 aa, Porcine reproductive and respiratory syndrome virus; identical to SEQ ID NO: 47

SEQ ID NO: 1479 - protein, 34 aa, Porcine reproductive and respiratory syndrome virus; identical to SEQ ID NO: 47

SEQ ID NO: 1480 - protein, 34 aa, Porcine reproductive and respiratory syndrome virus; identical to SEQ ID NO: 39

SEQ ID NO: 1481 - protein, 34 aa, Porcine reproductive and respiratory syndrome virus; identical to SEQ ID NO: 46

SEQ ID NO: 1482 - protein, 34 aa, Porcine reproductive and respiratory syndrome virus; identical to SEQ ID NO: 55

SEQ ID NO: 1483 - protein, 34 aa, Porcine reproductive and respiratory syndrome virus; identical to SEQ ID NO: 55

SEQ ID NO: 1484 - protein, 34 aa, Porcine reproductive and respiratory syndrome virus; identical to SEQ ID NO: 256

SEQ ID NO: 1485 - protein, 34 aa, Porcine reproductive and respiratory syndrome virus
LVNANSSSSSHLQLIYNLTLCELNGTDWLAGKFD

SEQ ID NO: 1486 - protein, 34 aa, Porcine reproductive and respiratory syndrome virus; identical to SEQ ID NO: 38

SEQ ID NO: 1487 - protein, 34 aa, Porcine reproductive and respiratory syndrome virus; identical to SEQ ID NO: 47

SEQ ID NO: 1488 - protein, 34 aa, Porcine reproductive and respiratory syndrome virus; identical to SEQ ID NO: 47

SEQ ID NO: 1489 - protein, 34 aa, Porcine reproductive and respiratory syndrome virus; identical to SEQ ID NO: 47

SEQ ID NO: 1490 - protein, 34 aa, Porcine reproductive and respiratory syndrome virus; identical to SEQ ID NO: 55

SEQ ID NO: 1491 - protein, 34 aa, Porcine reproductive and respiratory syndrome virus; identical to SEQ ID NO: 484

SEQ ID NO: 1492 - protein, 34 aa, Porcine reproductive and respiratory syndrome virus; identical to SEQ ID NO: 655

SEQ ID NO: 1493 - protein, 34 aa, Porcine reproductive and respiratory syndrome virus; identical to SEQ ID NO: 694

SEQ ID NO: 1494 - protein, 34 aa, Porcine reproductive and respiratory syndrome virus; identical to SEQ ID NO: 47

SEQ ID NO: 1495 - protein, 34 aa, Porcine reproductive and respiratory syndrome virus; identical to SEQ ID NO: 47

SEQ ID NO: 1496 - protein, 34 aa, Porcine reproductive and respiratory syndrome virus; identical to SEQ ID NO: 47

SEQ ID NO: 1497 - protein, 34 aa, Porcine reproductive and respiratory syndrome virus; identical to SEQ ID NO: 487

SEQ ID NO: 1498 - protein, 34 aa, Porcine reproductive and respiratory syndrome virus; identical to SEQ ID NO: 55

SEQ ID NO: 1499 - protein, 34 aa, Porcine reproductive and respiratory syndrome virus; identical to SEQ ID NO: 475

SEQ ID NO: 1500 - protein, 34 aa, Porcine reproductive and respiratory syndrome virus; identical to SEQ ID NO: 188

SEQ ID NO: 1501 - protein, 34 aa, Porcine reproductive and respiratory syndrome virus
LVNANSNRSSHLQLIYNLTLCELNGTDWLKDKFD

SEQ ID NO: 1502 - protein, 34 aa, Porcine reproductive and respiratory syndrome virus; identical to SEQ ID NO: 862

SEQ ID NO: 1503 - protein, 34 aa, Porcine reproductive and respiratory syndrome virus; identical to SEQ ID NO: 188

SEQ ID NO: 1504 - protein, 34 aa, Porcine reproductive and respiratory syndrome virus; identical to SEQ ID NO: 519

SEQ ID NO: 1505 - protein, 34 aa, Porcine reproductive and respiratory syndrome virus
LVNANSSSSSHFQLIYNLTLCELNGTDWLANKFD

SEQ ID NO: 1506 - protein, 34 aa, Porcine reproductive and respiratory syndrome virus; identical to SEQ ID NO: 188

SEQ ID NO: 1507 - protein, 34 aa, Porcine reproductive and respiratory syndrome virus; identical to SEQ ID NO: 1005

SEQ ID NO: 1508 - protein, 34 aa, Porcine reproductive and respiratory syndrome virus; identical to SEQ ID NO: 680

SEQ ID NO: 1509 - protein, 34 aa, Porcine reproductive and respiratory syndrome virus
PVNANNTSSSHFQSIYNLTLCELNGTDWLASHFD

SEQ ID NO: 1510 - protein, 34 aa, Porcine reproductive and respiratory syndrome virus
LVNASNNNSSHLQLIYNLTICELNGTDWLNNKFD

SEQ ID NO: 1511 - protein, 34 aa, Porcine reproductive and respiratory syndrome virus; identical to SEQ ID NO: 1510

SEQ ID NO: 1512 - protein, 34 aa, Porcine reproductive and respiratory syndrome virus; identical to SEQ ID NO: 267

SEQ ID NO: 1513 - protein, 34 aa, Porcine reproductive and respiratory syndrome virus
  misc_feature (6)..(6): Xaa can be any naturally occurring amino acid
LVNASXNSSSHLQLIYNLTICELNGTEWLNNHFS

SEQ ID NO: 1514 - protein, 34 aa, Porcine reproductive and respiratory syndrome virus; identical to SEQ ID NO: 1271

SEQ ID NO: 1515 - protein, 34 aa, Porcine reproductive and respiratory syndrome virus
  misc_feature (5)..(5): Xaa can be any naturally occurring amino acid
LVNAXSNSSSHLQLIYNLTLCELNGTDWLRDKFD

SEQ ID NO: 1516 - protein, 34 aa, Porcine reproductive and respiratory syndrome virus
LVNASSNSSSHLQLIYNLTICELNGTGWLNNHFS

SEQ ID NO: 1517 - protein, 34 aa, Porcine reproductive and respiratory syndrome virus
  misc_feature (5)..(5): Xaa can be any naturally occurring amino acid
LVNAXGNSSSHLQLIYNLTICELNGTDWLNDHFS

SEQ ID NO: 1518 - protein, 34 aa, Porcine reproductive and respiratory syndrome virus; identical to SEQ ID NO: 267

SEQ ID NO: 1519 - protein, 34 aa, Porcine reproductive and respiratory syndrome virus; identical to SEQ ID NO: 1505

SEQ ID NO: 1520 - protein, 34 aa, Porcine reproductive and respiratory syndrome virus; identical to SEQ ID NO: 1061

SEQ ID NO: 1521 - protein, 34 aa, Porcine reproductive and respiratory syndrome virus
LVNADSSSSSHLQLIYNLTICELNGTDWLNTKFD

SEQ ID NO: 1522 - protein, 34 aa, Porcine reproductive and respiratory syndrome virus
  misc_feature (7)..(7): Xaa can be any naturally occurring amino acid
LVNASNXSSSHLQLIYNLTICELNGTDWLNEHFS

SEQ ID NO: 1523 - protein, 34 aa, Porcine reproductive and respiratory syndrome virus; identical to SEQ ID NO: 878

SEQ ID NO: 1524 - protein, 34 aa, Porcine reproductive and respiratory syndrome virus; identical to SEQ ID NO: 188

SEQ ID NO: 1525 - protein, 34 aa, Porcine reproductive and respiratory syndrome virus; identical to SEQ ID NO: 756

SEQ ID NO: 1526 - protein, 34 aa, Porcine reproductive and respiratory syndrome virus
LVNAGNHSSSHLQLIYNLTICELNGTDWLNNRFS

SEQ ID NO: 1527 - protein, 34 aa, Porcine reproductive and respiratory syndrome virus
LVNANSSSSSHFQLIYNLTLCELNGTDWLANRFD

SEQ ID NO: 1528 - protein, 34 aa, Porcine reproductive and respiratory syndrome virus
LVNASNNNSSHLQLIYNLTICELNGTDWLNDHFS

SEQ ID NO: 1529 - protein, 34 aa, Porcine reproductive and respiratory syndrome virus; identical to SEQ ID NO: 493

SEQ ID NO: 1530 - protein, 34 aa, Porcine reproductive and respiratory syndrome virus
  misc_feature (5)..(5): Xaa can be any naturally occurring amino acid
LVNAXSNNSSHLQLIYNLTICELNGTDWLNEHFS

SEQ ID NO: 1531 - protein, 34 aa, Porcine reproductive and respiratory syndrome virus
LVNAKSNSSSHLQLIYNLTICELNGTDWLNNHFS

SEQ ID NO: 1532 - protein, 34 aa, Porcine reproductive and respiratory syndrome virus
LVNANSNSSSHLQSIYNLTICELNGTDWLNSHFS

SEQ ID NO: 1533 - protein, 34 aa, Porcine reproductive and respiratory syndrome virus; identical to SEQ ID NO: 827

SEQ ID NO: 1534 - protein, 34 aa, Porcine reproductive and respiratory syndrome virus
LVNASSNGSSHLQLIYNLTLCELNGTDWLKNKFD

SEQ ID NO: 1535 - protein, 34 aa, Porcine reproductive and respiratory syndrome virus; identical to SEQ ID NO: 475

SEQ ID NO: 1536 - protein, 34 aa, Porcine reproductive and respiratory syndrome virus; identical to SEQ ID NO: 75

SEQ ID NO: 1537 - protein, 34 aa, Porcine reproductive and respiratory syndrome virus
LVNADSNNSSQLQLIYNLTICELNGTDWLDNHFS

SEQ ID NO: 1538 - protein, 34 aa, Porcine reproductive and respiratory syndrome virus; identical to SEQ ID NO: 996

SEQ ID NO: 1539 - protein, 34 aa, Porcine reproductive and respiratory syndrome virus
LVNASSNSSSHLQLIYNLTICELNGTGWLNDHFS

SEQ ID NO: 1540 - protein, 34 aa, Porcine reproductive and respiratory syndrome virus; identical to SEQ ID NO: 236

SEQ ID NO: 1541 - protein, 34 aa, Porcine reproductive and respiratory syndrome virus
LVNADSNNSSHLQLIYKLTICELNGTDWLDNHFS

SEQ ID NO: 1542 - protein, 34 aa, Porcine reproductive and respiratory syndrome virus
LVNANSNSSSHLQLIYNLTLCELNGTDWLEGKFD

SEQ ID NO: 1543 - protein, 34 aa, Porcine reproductive and respiratory syndrome virus
LVNADSNNSSHLQLIYNLTICELNGTDWLNEHFS

SEQ ID NO: 1544 - protein, 34 aa, Porcine reproductive and respiratory syndrome virus; identical to SEQ ID NO: 1128

SEQ ID NO: 1545 - protein, 34 aa, Porcine reproductive and respiratory syndrome virus; identical to SEQ ID NO: 1100

SEQ ID NO: 1546 - protein, 34 aa, Porcine reproductive and respiratory syndrome virus
LVNAENNSSSHLQLIYNLTICELNGTDWLNRKFD

SEQ ID NO: 1547 - protein, 34 aa, Porcine reproductive and respiratory syndrome virus; identical to SEQ ID NO: 475

SEQ ID NO: 1548 - protein, 34 aa, Porcine reproductive and respiratory syndrome virus
SFVDGNDTNSTYQYIYNLTICELNGTNWLSNHFE

SEQ ID NO: 1549 - protein, 34 aa, Porcine reproductive and respiratory syndrome virus; identical to SEQ ID NO: 680

SEQ ID NO: 1550 - protein, 34 aa, Porcine reproductive and respiratory syndrome virus
LVNASGNSSSHLQLIYNLTICELNGTDWLDKHFS

SEQ ID NO: 1551 - protein, 34 aa, Porcine reproductive and respiratory syndrome virus; identical to SEQ ID NO: 188

SEQ ID NO: 1552 - protein, 34 aa, Porcine reproductive and respiratory syndrome virus
LVNANSNGSSHLQLIYNLTLCELNGTDWLANRFD

SEQ ID NO: 1553 - protein, 34 aa, Porcine reproductive and respiratory syndrome virus
LVNANSNSSSHFQLIYNLTLCELNGTDWLANRFD

SEQ ID NO: 1554 - protein, 34 aa, Porcine reproductive and respiratory syndrome virus; identical to SEQ ID NO: 910

SEQ ID NO: 1555 - protein, 34 aa, Porcine reproductive and respiratory syndrome virus
LVNANSDNSSHLQLIYNLTICELNGTDWLNEHFS

SEQ ID NO: 1556 - protein, 34 aa, Porcine reproductive and respiratory syndrome virus; identical to SEQ ID NO: 680

SEQ ID NO: 1557 - protein, 34 aa, Porcine reproductive and respiratory syndrome virus
LVNANSSSSSHFQLIYSLTLCELNGTDWLANKFD

SEQ ID NO: 1558 - protein, 34 aa, Porcine reproductive and respiratory syndrome virus; identical to SEQ ID NO: 1271

SEQ ID NO: 1559 - protein, 34 aa, Porcine reproductive and respiratory syndrome virus
LVNASNNSSSHFQLIYNLTICELNGTDWLNNHFS

SEQ ID NO: 1560 - protein, 34 aa, Porcine reproductive and respiratory syndrome virus
LVNASSNSSSHLQLIYNLTLCELNGTDWLRNKFD

SEQ ID NO: 1561 - protein, 34 aa, Porcine reproductive and respiratory syndrome virus
LVNANSSSSSHFQLIYNLTLCELNGTDWLNKHFN

SEQ ID NO: 1562 - protein, 34 aa, Porcine reproductive and respiratory syndrome virus
LVNANSDSSSHLQLIYNLTICELNGTDWLDEHFS

SEQ ID NO: 1563 - protein, 34 aa, Porcine reproductive and respiratory syndrome virus
LVDANSNSSSHLQLIYNLTLCELNGTDWLANRFD

SEQ ID NO: 1564 - protein, 34 aa, Porcine reproductive and respiratory syndrome virus; identical to SEQ ID NO: 1227

SEQ ID NO: 1565 - protein, 34 aa, Porcine reproductive and respiratory syndrome virus; identical to SEQ ID NO: 1552

SEQ ID NO: 1566 - protein, 34 aa, Porcine reproductive and respiratory syndrome virus; identical to SEQ ID NO: 55

SEQ ID NO: 1567 - protein, 34 aa, Porcine reproductive and respiratory syndrome virus
LVNANSNSSSHFQLIYNLTLCELNGTDWLASKFD

SEQ ID NO: 1568 - protein, 34 aa, Porcine reproductive and respiratory syndrome virus
LVNANSNSSSHLQLIYNLTICELNGTEWLGSHFS

SEQ ID NO: 1569 - protein, 34 aa, Porcine reproductive and respiratory syndrome virus; identical to SEQ ID NO: 1552

SEQ ID NO: 1570 - protein, 34 aa, Porcine reproductive and respiratory syndrome virus
LVNANSNSSSHFQLIYNLTICELNGTEWLSKHFS

SEQ ID NO: 1571 - protein, 34 aa, Porcine reproductive and respiratory syndrome virus
LVNADHNSSSHLQLIYNLTICELNGTDWLDKKFD

SEQ ID NO: 1572 - protein, 34 aa, Porcine reproductive and respiratory syndrome virus; identical to SEQ ID NO: 1571

SEQ ID NO: 1573 - protein, 34 aa, Porcine reproductive and respiratory syndrome virus; identical to SEQ ID NO: 473

SEQ ID NO: 1574 - protein, 34 aa, Porcine reproductive and respiratory syndrome virus; identical to SEQ ID NO: 267

SEQ ID NO: 1575 - protein, 34 aa, Porcine reproductive and respiratory syndrome virus
LANASBDSSSHLQLIYNLTLCELNGTDWLANKFD

SEQ ID NO: 1576 - protein, 34 aa, Porcine reproductive and respiratory syndrome virus; identical to SEQ ID NO: 1031

SEQ ID NO: 1577 - protein, 34 aa, Porcine reproductive and respiratory syndrome virus; identical to SEQ ID NO: 680

SEQ ID NO: 1578 - protein, 34 aa, Porcine reproductive and respiratory syndrome virus; identical to SEQ ID NO: 837

SEQ ID NO: 1579 - protein, 34 aa, Porcine reproductive and respiratory syndrome virus; identical to SEQ ID NO: 55

SEQ ID NO: 1580 - protein, 34 aa, Porcine reproductive and respiratory syndrome virus; identical to SEQ ID NO: 1301

SEQ ID NO: 1581 - protein, 34 aa, Porcine reproductive and respiratory syndrome virus
LVNANSNNSSHLQLIYNLTICELNGTDWLNKHFS

SEQ ID NO: 1582 - protein, 34 aa, Porcine reproductive and respiratory syndrome virus; identical to SEQ ID NO: 223

SEQ ID NO: 1583 - protein, 34 aa, Porcine reproductive and respiratory syndrome virus; identical to SEQ ID NO: 1061

SEQ ID NO: 1584 - protein, 34 aa, Porcine reproductive and respiratory syndrome virus
LVNANSNSSSHLQLIYNLTICELNGTDWLNKKFD

SEQ ID NO: 1585 - protein, 34 aa, Porcine reproductive and respiratory syndrome virus
LVNASSNSSSHLQLIYNLTICELNGTDWLNSQFS

SEQ ID NO: 1586 - protein, 34 aa, Porcine reproductive and respiratory syndrome virus; identical to SEQ ID NO: 1537

SEQ ID NO: 1587 - protein, 34 aa, Porcine reproductive and respiratory syndrome virus; identical to SEQ ID NO: 1207

SEQ ID NO: 1588 - protein, 34 aa, Porcine reproductive and respiratory syndrome virus
LVNASNHSSSHLQLIYNLTICELNGTDWLNNHFS

SEQ ID NO: 1589 - protein, 34 aa, Porcine reproductive and respiratory syndrome virus
LVNADSNNSSQLQLIYNLTICELNGTDWLNNHFS

SEQ ID NO: 1590 - protein, 34 aa, Porcine reproductive and respiratory syndrome virus; identical to SEQ ID NO: 1589

SEQ ID NO: 1591 - protein, 34 aa, Porcine reproductive and respiratory syndrome virus; identical to SEQ ID NO: 509

SEQ ID NO: 1592 - protein, 34 aa, Porcine reproductive and respiratory syndrome virus; identical to SEQ ID NO: 486

SEQ ID NO: 1593 - protein, 34 aa, Porcine reproductive and respiratory syndrome virus
LANADNNSSSHLQLIYNLTLCELNGTDWLANKFD

SEQ ID NO: 1594 - protein, 34 aa, Porcine reproductive and respiratory syndrome virus; identical to SEQ ID NO: 876

SEQ ID NO: 1595 - protein, 34 aa, Porcine reproductive and respiratory syndrome virus; identical to SEQ ID NO: 223

SEQ ID NO: 1596 - protein, 34 aa, Porcine reproductive and respiratory syndrome virus; identical to SEQ ID NO: 47

SEQ ID NO: 1597 - protein, 34 aa, Porcine reproductive and respiratory syndrome virus; identical to SEQ ID NO: 350

SEQ ID NO: 1598 - protein, 34 aa, Porcine reproductive and respiratory syndrome virus
LVNANSTSSSYSQLIYNLTLCELNGTDWLNGHFS

SEQ ID NO: 1599 - protein, 34 aa, Porcine reproductive and respiratory syndrome virus
LANADNNSSSHLQLIYNLTLCELNGTDWLADKFD

SEQ ID NO: 1600 - protein, 34 aa, Porcine reproductive and respiratory syndrome virus; identical to SEQ ID NO: 1271

SEQ ID NO: 1601 - protein, 34 aa, Porcine reproductive and respiratory syndrome virus
LVNASGNSSSHFQLIYNLTICELNGTGWLNDHFS

SEQ ID NO: 1602 - protein, 34 aa, Porcine reproductive and respiratory syndrome virus
LVNARSNSSSHLQLIYNLTICELNGTDWLNNHFS

SEQ ID NO: 1603 - protein, 34 aa, Porcine reproductive and respiratory syndrome virus; identical to SEQ ID NO: 1271

SEQ ID NO: 1604 - protein, 34 aa, Porcine reproductive and respiratory syndrome virus
LVNASSNSSSHIQLIYNLTLCELNGTDWLSGKFD

SEQ ID NO: 1605 - protein, 34 aa, Porcine reproductive and respiratory syndrome virus; identical to SEQ ID NO: 680

SEQ ID NO: 1606 - protein, 34 aa, Porcine reproductive and respiratory syndrome virus; identical to SEQ ID NO: 680

SEQ ID NO: 1607 - protein, 34 aa, Porcine reproductive and respiratory syndrome virus
LVNANSNHSSHFQLIYNLTLCELNGTDWLANKFD

SEQ ID NO: 1608 - protein, 34 aa, Porcine reproductive and respiratory syndrome virus
LVNASNBSSSHLQLIYNLTICELNGTDWLNEHFS

SEQ ID NO: 1609 - protein, 34 aa, Porcine reproductive and respiratory syndrome virus
LVNANSNSSSHLQSIYNLTICELNGTEWLDEHFS

SEQ ID NO: 1610 - protein, 34 aa, Porcine reproductive and respiratory syndrome virus; identical to SEQ ID NO: 1288

SEQ ID NO: 1611 - protein, 34 aa, Porcine reproductive and respiratory syndrome virus; identical to SEQ ID NO: 1236

SEQ ID NO: 1612 - protein, 34 aa, Porcine reproductive and respiratory syndrome virus; identical to SEQ ID NO: 680

SEQ ID NO: 1613 - protein, 34 aa, Porcine reproductive and respiratory syndrome virus
LVNANSNSSSHLQLIYNLTLCELNGTDWLKGKFN

SEQ ID NO: 1614 - protein, 34 aa, Porcine reproductive and respiratory syndrome virus; identical to SEQ ID NO: 267

SEQ ID NO: 1615 - protein, 34 aa, Porcine reproductive and respiratory syndrome virus; identical to SEQ ID NO: 680

SEQ ID NO: 1616 - protein, 34 aa, Porcine reproductive and respiratory syndrome virus; identical to SEQ ID NO: 462

SEQ ID NO: 1617 - protein, 34 aa, Porcine reproductive and respiratory syndrome virus
LVSANGNSSSHLQLIYNLTICELNGTDWLNNHFS

SEQ ID NO: 1618 - protein, 34 aa, Porcine reproductive and respiratory syndrome virus
LVNADSNSSSHLQLIYNLTLCELNGTDWLKDKFD

SEQ ID NO: 1619 - protein, 34 aa, Porcine reproductive and respiratory syndrome virus; identical to SEQ ID NO: 470

SEQ ID NO: 1620 - protein, 34 aa, Porcine reproductive and respiratory syndrome virus
LVNAGNSSSSHLQLIYNLTICELNGTDWLKNHFS

SEQ ID NO: 1621 - protein, 34 aa, Porcine reproductive and respiratory syndrome virus
LANASGNSSSHLQLIYNLTLCELNGTDWLADKFD

SEQ ID NO: 1622 - protein, 34 aa, Porcine reproductive and respiratory syndrome virus
LVNANNDSSSHLQLIYNLTICELNGTDWLGNKFD

SEQ ID NO: 1623 - protein, 34 aa, Porcine reproductive and respiratory syndrome virus; identical to SEQ ID NO: 720

SEQ ID NO: 1624 - protein, 34 aa, Porcine reproductive and respiratory syndrome virus
LVNANSNSSSHFQLIYNLTLCELNGTEWLSNKFD

SEQ ID NO: 1625 - protein, 34 aa, Porcine reproductive and respiratory syndrome virus; identical to SEQ ID NO: 1291

SEQ ID NO: 1626 - protein, 34 aa, Porcine reproductive and respiratory syndrome virus; identical to SEQ ID NO: 768

SEQ ID NO: 1627 - protein, 34 aa, Porcine reproductive and respiratory syndrome virus
LVNAHGNSSSHLQLIYNLTICELNGTDWLNNHFS

SEQ ID NO: 1628 - protein, 34 aa, Porcine reproductive and respiratory syndrome virus; identical to SEQ ID NO: 188

SEQ ID NO: 1629 - protein, 34 aa, Porcine reproductive and respiratory syndrome virus; identical to SEQ ID NO: 1291

SEQ ID NO: 1630 - protein, 34 aa, Porcine reproductive and respiratory syndrome virus; identical to SEQ ID NO: 461

SEQ ID NO: 1631 - protein, 34 aa, Porcine reproductive and respiratory syndrome virus; identical to SEQ ID NO: 484

SEQ ID NO: 1632 - protein, 34 aa, Porcine reproductive and respiratory syndrome virus; identical to SEQ ID NO: 680

SEQ ID NO: 1633 - protein, 34 aa, Porcine reproductive and respiratory syndrome virus
LVNASSNSSSHLQLIYNLTICELNGTDWLNEKFD

SEQ ID NO: 1634 - protein, 34 aa, Porcine reproductive and respiratory syndrome virus
LVNASSNSSSHFQLIYNLTICELNGTDWLNNHFS

SEQ ID NO: 1635 - protein, 34 aa, Porcine reproductive and respiratory syndrome virus
LVNADNSSSSHFQLIYNLTLCELNGTEWLANKFD

SEQ ID NO: 1636 - protein, 34 aa, Porcine reproductive and respiratory syndrome virus
LVNANSSSSSHFQLIYNLTLCELNGTDWLADRFD

SEQ ID NO: 1637 - protein, 34 aa, Porcine reproductive and respiratory syndrome virus
LVNASDNSSSHFQLIYNLTLCELNGTDWLANKFD

SEQ ID NO: 1638 - protein, 34 aa, Porcine reproductive and respiratory syndrome virus; identical to SEQ ID NO: 58

SEQ ID NO: 1639 - protein, 34 aa, Porcine reproductive and respiratory syndrome virus; identical to SEQ ID NO: 680

SEQ ID NO: 1640 - protein, 34 aa, Porcine reproductive and respiratory syndrome virus
LVNASSDSSSHLQLIYNLTICELNGTDWLNGHFS

SEQ ID NO: 1641 - protein, 34 aa, Porcine reproductive and respiratory syndrome virus
LVNASSNSSSHLQLIYNLTICELNGTDWLDEHFS

SEQ ID NO: 1642 - protein, 34 aa, Porcine reproductive and respiratory syndrome virus
LANAHSDNSSHLQLIYNLTICELNGTDWLNKHFS

SEQ ID NO: 1643 - protein, 34 aa, Porcine reproductive and respiratory syndrome virus; identical to SEQ ID NO: 188

SEQ ID NO: 1644 - protein, 34 aa, Porcine reproductive and respiratory syndrome virus
LVNARGNSSSHLQLIYNLTICELNGTDWLNNHFS

SEQ ID NO: 1645 - protein, 34 aa, Porcine reproductive and respiratory syndrome virus
LVNANSDSSSHLQLIYNLTICELNGTDWLNNHFS

SEQ ID NO: 1646 - protein, 34 aa, Porcine reproductive and respiratory syndrome virus; identical to SEQ ID NO: 945

SEQ ID NO: 1647 - protein, 34 aa, Porcine reproductive and respiratory syndrome virus; identical to SEQ ID NO: 1121

SEQ ID NO: 1648 - protein, 34 aa, Porcine reproductive and respiratory syndrome virus
LVNASNDSSSHLQLIYNLTICELNGTDWLNSHFS

SEQ ID NO: 1649 - protein, 34 aa, Porcine reproductive and respiratory syndrome virus; identical to SEQ ID NO: 513

SEQ ID NO: 1650 - protein, 34 aa, Porcine reproductive and respiratory syndrome virus; identical to SEQ ID NO: 250

SEQ ID NO: 1651 - protein, 34 aa, Porcine reproductive and respiratory syndrome virus; identical to SEQ ID NO: 475

SEQ ID NO: 1652 - protein, 34 aa, Porcine reproductive and respiratory syndrome virus; identical to SEQ ID NO: 188

SEQ ID NO: 1653 - protein, 34 aa, Porcine reproductive and respiratory syndrome virus; identical to SEQ ID NO: 188

SEQ ID NO: 1654 - protein, 34 aa, Porcine reproductive and respiratory syndrome virus
LVNASSNSSSHLQLIYNLTICELNGTEWLSNHFS

SEQ ID NO: 1655 - protein, 34 aa, Porcine reproductive and respiratory syndrome virus; identical to SEQ ID NO: 910

SEQ ID NO: 1656 - protein, 34 aa, Porcine reproductive and respiratory syndrome virus
  misc_feature (5)..(7): Xaa can be any naturally occurring amino acid
LVNAXXXSSSHLQLIYNLTICELNGTDWLNNHFS

SEQ ID NO: 1657 - protein, 34 aa, Porcine reproductive and respiratory syndrome virus; identical to SEQ ID NO: 720

SEQ ID NO: 1658 - protein, 34 aa, Porcine reproductive and respiratory syndrome virus; identical to SEQ ID NO: 55

SEQ ID NO: 1659 - protein, 34 aa, Porcine reproductive and respiratory syndrome virus; identical to SEQ ID NO: 486

SEQ ID NO: 1660 - protein, 34 aa, Porcine reproductive and respiratory syndrome virus; identical to SEQ ID NO: 680

SEQ ID NO: 1661 - protein, 34 aa, Porcine reproductive and respiratory syndrome virus; identical to SEQ ID NO: 350

SEQ ID NO: 1662 - protein, 34 aa, Porcine reproductive and respiratory syndrome virus; identical to SEQ ID NO: 874

SEQ ID NO: 1663 - protein, 34 aa, Porcine reproductive and respiratory syndrome virus
LVNASGNSSSHLQLIYNLTICELNGTDWLDNHFS

SEQ ID NO: 1664 - protein, 34 aa, Porcine reproductive and respiratory syndrome virus; identical to SEQ ID NO: 350

SEQ ID NO: 1665 - protein, 34 aa, Porcine reproductive and respiratory syndrome virus; identical to SEQ ID NO: 906

SEQ ID NO: 1666 - protein, 34 aa, Porcine reproductive and respiratory syndrome virus
LVNASNDSSSHLQLIYNLTICELNGTDWLDNKFD

SEQ ID NO: 1667 - protein, 34 aa, Porcine reproductive and respiratory syndrome virus; identical to SEQ ID NO: 1121

SEQ ID NO: 1668 - protein, 34 aa, Porcine reproductive and respiratory syndrome virus
LVNANSNSSSHLQLIYNLTICELNGTDWLNDHFS

SEQ ID NO: 1669 - protein, 34 aa, Porcine reproductive and respiratory syndrome virus
LVNANSNSSSHLQLIYNLTLCELNGTQWLAGRFD

SEQ ID NO: 1670 - protein, 34 aa, Porcine reproductive and respiratory syndrome virus; identical to SEQ ID NO: 188

SEQ ID NO: 1671 - protein, 34 aa, Porcine reproductive and respiratory syndrome virus; identical to SEQ ID NO: 47

SEQ ID NO: 1672 - protein, 34 aa, Porcine reproductive and respiratory syndrome virus
LANANSNSSSHLQLIYNLTLCELNGTDWLANRFD

SEQ ID NO: 1673 - protein, 34 aa, Porcine reproductive and respiratory syndrome virus
LANASRNSSSHLQLIYNLTLCELNGTDWLADKFD

SEQ ID NO: 1674 - protein, 34 aa, Porcine reproductive and respiratory syndrome virus; identical to SEQ ID NO: 360

SEQ ID NO: 1675 - protein, 34 aa, Porcine reproductive and respiratory syndrome virus
LVNASNNSSSHLQLIYNLTICELNGTDWLNNKFD

SEQ ID NO: 1676 - protein, 34 aa, Porcine reproductive and respiratory syndrome virus
LVNANSNSSSHLQLIYNLTICELNGTDWLDDKFD

SEQ ID NO: 1677 - protein, 34 aa, Porcine reproductive and respiratory syndrome virus; identical to SEQ ID NO: 360

SEQ ID NO: 1678 - protein, 34 aa, Porcine reproductive and respiratory syndrome virus; identical to SEQ ID NO: 1084

SEQ ID NO: 1679 - protein, 34 aa, Porcine reproductive and respiratory syndrome virus; identical to SEQ ID NO: 1084

SEQ ID NO: 1680 - protein, 34 aa, Porcine reproductive and respiratory syndrome virus; identical to SEQ ID NO: 55

SEQ ID NO: 1681 - protein, 34 aa, Porcine reproductive and respiratory syndrome virus
LVNANSNSSSHLQLIYNLTICELNGTDWLKEKFD

SEQ ID NO: 1682 - protein, 34 aa, Porcine reproductive and respiratory syndrome virus; identical to SEQ ID NO: 1084

SEQ ID NO: 1683 - protein, 34 aa, Porcine reproductive and respiratory syndrome virus
PANASNGSSSHLQLIYNLTLCELNGTDWLANKFD

SEQ ID NO: 1684 - protein, 34 aa, Porcine reproductive and respiratory syndrome virus
PANAGNDSSSHLQLIYNLTLCELNGTDWLANKFD

SEQ ID NO: 1685 - protein, 34 aa, Porcine reproductive and respiratory syndrome virus; identical to SEQ ID NO: 55

SEQ ID NO: 1686 - protein, 34 aa, Porcine reproductive and respiratory syndrome virus
LVSAHSNSSSHLQLIYNLTLCELNGTDWLANKFD

SEQ ID NO: 1687 - protein, 34 aa, Porcine reproductive and respiratory syndrome virus; identical to SEQ ID NO: 21

SEQ ID NO: 1688 - protein, 34 aa, Porcine reproductive and respiratory syndrome virus
LVNAGNNSSSHLQLIYNLTLCELNGTDWLANKFD

SEQ ID NO: 1689 - protein, 34 aa, Porcine reproductive and respiratory syndrome virus
LANANSNSSSHLQLIYNLTLCELNGTDWLADRFD

SEQ ID NO: 1690 - protein, 34 aa, Porcine reproductive and respiratory syndrome virus; identical to SEQ ID NO: 1689

SEQ ID NO: 1691 - protein, 34 aa, Porcine reproductive and respiratory syndrome virus; identical to SEQ ID NO: 1144

SEQ ID NO: 1692 - protein, 34 aa, Porcine reproductive and respiratory syndrome virus; identical to SEQ ID NO: 1017

SEQ ID NO: 1693 - protein, 34 aa, Porcine reproductive and respiratory syndrome virus; identical to SEQ ID NO: 55

SEQ ID NO: 1694 - protein, 34 aa, Porcine reproductive and respiratory syndrome virus; identical to SEQ ID NO: 55

SEQ ID NO: 1695 - protein, 34 aa, Porcine reproductive and respiratory syndrome virus; identical to SEQ ID NO: 172

SEQ ID NO: 1696 - protein, 34 aa, Porcine reproductive and respiratory syndrome virus; identical to SEQ ID NO: 55

SEQ ID NO: 1697 - protein, 34 aa, Porcine reproductive and respiratory syndrome virus; identical to SEQ ID NO: 21

SEQ ID NO: 1698 - protein, 34 aa, Porcine reproductive and respiratory syndrome virus
LANASNNSSSHLQLIYNLTLCELNGTDWLVNKFD

SEQ ID NO: 1699 - protein, 34 aa, Porcine reproductive and respiratory syndrome virus; identical to SEQ ID NO: 47

SEQ ID NO: 1700 - protein, 34 aa, Porcine reproductive and respiratory syndrome virus; identical to SEQ ID NO: 1593

SEQ ID NO: 1701 - protein, 34 aa, Porcine reproductive and respiratory syndrome virus; identical to SEQ ID NO: 484

SEQ ID NO: 1702 - protein, 34 aa, Porcine reproductive and respiratory syndrome virus; identical to SEQ ID NO: 55

SEQ ID NO: 1703 - protein, 34 aa, Porcine reproductive and respiratory syndrome virus; identical to SEQ ID NO: 55

SEQ ID NO: 1704 - protein, 34 aa, Porcine reproductive and respiratory syndrome virus; identical to SEQ ID NO: 55

SEQ ID NO: 1705 - protein, 34 aa, Porcine reproductive and respiratory syndrome virus
LVNANSNSSSHLQLIYNLTLCELNGTDWLAGRFD

SEQ ID NO: 1706 - protein, 34 aa, Porcine reproductive and respiratory syndrome virus
LVNANSNSSSHLQLIYNLTLCELNGTDWLADNFD

SEQ ID NO: 1707 - protein, 34 aa, Porcine reproductive and respiratory syndrome virus; identical to SEQ ID NO: 223

SEQ ID NO: 1708 - protein, 34 aa, Porcine reproductive and respiratory syndrome virus
LVNASSNSSSHLQLIYNLTLCELNGTDWLANRFD

SEQ ID NO: 1709 - protein, 34 aa, Porcine reproductive and respiratory syndrome virus
LANANNDSSSHLQLIYNLTLCELNGTDWLANRFD

SEQ ID NO: 1710 - protein, 34 aa, Porcine reproductive and respiratory syndrome virus; identical to SEQ ID NO: 700

SEQ ID NO: 1711 - protein, 34 aa, Porcine reproductive and respiratory syndrome virus; identical to SEQ ID NO: 1148

SEQ ID NO: 1712 - protein, 34 aa, Porcine reproductive and respiratory syndrome virus; identical to SEQ ID NO: 680

SEQ ID NO: 1713 - protein, 34 aa, Porcine reproductive and respiratory syndrome virus; identical to SEQ ID NO: 874

SEQ ID NO: 1714 - protein, 34 aa, Porcine reproductive and respiratory syndrome virus; identical to SEQ ID NO: 15

SEQ ID NO: 1715 - protein, 34 aa, Porcine reproductive and respiratory syndrome virus; identical to SEQ ID NO: 363

SEQ ID NO: 1716 - protein, 34 aa, Porcine reproductive and respiratory syndrome virus; identical to SEQ ID NO: 364

SEQ ID NO: 1717 - protein, 34 aa, Porcine reproductive and respiratory syndrome virus
LVNASSNNSSHIQLIYNLTLCELNGTDWLAQKFD

SEQ ID NO: 1718 - protein, 34 aa, Porcine reproductive and respiratory syndrome virus
SFADGNGNSSTYQYIYDLTICELNGTAWLSTHFS

SEQ ID NO: 1719 - protein, 34 aa, Porcine reproductive and respiratory syndrome virus
SFADGNGNSSTYQYIYNLTICELNGTAWLSTHFS

SEQ ID NO: 1720 - protein, 34 aa, Porcine reproductive and respiratory syndrome virus
LVNASNNNSSHIQLIYNLTLCELNGTDWLANKFD

SEQ ID NO: 1721 - protein, 34 aa, Porcine reproductive and respiratory syndrome virus
LVNASNNSSSHIQLIYNLTLCELNGTDWLAQKFD

SEQ ID NO: 1722 - protein, 34 aa, Porcine reproductive and respiratory syndrome virus
SFADGNGNSSTYQYIYNLTICELNGTEWLSNHFE

SEQ ID NO: 1723 - protein, 34 aa, Porcine reproductive and respiratory syndrome virus
SFVAGSGNSSTYQYIYNLTICELNGTEWLSSHFD

SEQ ID NO: 1724 - protein, 34 aa, Porcine reproductive and respiratory syndrome virus
SFVVGNGNSSTYQYIYNLTICELNGTTWLSSHFD

SEQ ID NO: 1725 - protein, 34 aa, Porcine reproductive and respiratory syndrome virus; identical to SEQ ID NO: 336

SEQ ID NO: 1726 - protein, 34 aa, Porcine reproductive and respiratory syndrome virus
SFVDGNDNNSTYQYIYNLTICELNGTIWLSSHFV

SEQ ID NO: 1727 - protein, 34 aa, Porcine reproductive and respiratory syndrome virus
SFADGNGNSSTYQYIYNLTICELNGTTWLSSHFS

SEQ ID NO: 1728 - protein, 34 aa, Porcine reproductive and respiratory syndrome virus; identical to SEQ ID NO: 336

SEQ ID NO: 1729 - protein, 34 aa, Porcine reproductive and respiratory syndrome virus; identical to SEQ ID NO: 336

SEQ ID NO: 1730 - protein, 34 aa, Porcine reproductive and respiratory syndrome virus
SFADGNGNSSAYQYIYNLTICELNGTEWLSNHFS

SEQ ID NO: 1731 - protein, 34 aa, Porcine reproductive and respiratory syndrome virus
SFVDGSDNSSTYQYIYNLTICELNGTAWLSGHFD

SEQ ID NO: 1732 - protein, 34 aa, Porcine reproductive and respiratory syndrome virus
SFVDGSNNSSTYQYIYNLTICELNGTKWLSSHFD

SEQ ID NO: 1733 - protein, 34 aa, Porcine reproductive and respiratory syndrome virus; identical to SEQ ID NO: 399

SEQ ID NO: 1734 - protein, 34 aa, Porcine reproductive and respiratory syndrome virus; identical to SEQ ID NO: 22

SEQ ID NO: 1735 - protein, 34 aa, Porcine reproductive and respiratory syndrome virus; identical to SEQ ID NO: 336

SEQ ID NO: 1736 - protein, 34 aa, Porcine reproductive and respiratory syndrome virus
SFVDGNDNSSTYQYIYNLTICELNGTKWLSSHFD

SEQ ID NO: 1737 - protein, 34 aa, Porcine reproductive and respiratory syndrome virus
SFADGNGNNSTYQYIYNLTICELNGTDWLSNHFS

SEQ ID NO: 1738 - protein, 34 aa, Porcine reproductive and respiratory syndrome virus
SFVDGNGTNSTYQYIYNLTICELNGTHWLSDHFE

SEQ ID NO: 1739 - protein, 34 aa, Porcine reproductive and respiratory syndrome virus
SFADGNGNNSTYQYIYNLTICELNGTDWLSGHFE

SEQ ID NO: 1740 - protein, 34 aa, Porcine reproductive and respiratory syndrome virus
LVNASDSSSSHLQLIYNLTLCELNGTDWLADKFD

SEQ ID NO: 1741 - protein, 34 aa, Porcine reproductive and respiratory syndrome virus; identical to SEQ ID NO: 655

SEQ ID NO: 1742 - protein, 34 aa, Porcine reproductive and respiratory syndrome virus
LVNANSSSSSHLQLIYNLTLCELNGTDWLAERFD

SEQ ID NO: 1743 - protein, 34 aa, Porcine reproductive and respiratory syndrome virus
LVNANSNSSSHLQLIYNLTLCELNGTDWLAQKFD

SEQ ID NO: 1744 - protein, 34 aa, Porcine reproductive and respiratory syndrome virus; identical to SEQ ID NO: 502

SEQ ID NO: 1745 - protein, 34 aa, Porcine reproductive and respiratory syndrome virus
LVNADSNSSSHLQLIYNLTLCELNGTDWLANKFD

SEQ ID NO: 1746 - protein, 34 aa, Porcine reproductive and respiratory syndrome virus
LVNANSNSSSHFQLIYNMTLCELNGTDWLAGKFD

SEQ ID NO: 1747 - protein, 34 aa, Porcine reproductive and respiratory syndrome virus
LVNANNSSSSHLQLIYNLTLCELNGTDWLANKFD

SEQ ID NO: 1748 - protein, 34 aa, Porcine reproductive and respiratory syndrome virus
LVNANSDSSSHLQLIYNLTLCELNGTDWLANRFD

SEQ ID NO: 1749 - protein, 34 aa, Porcine reproductive and respiratory syndrome virus
LVNANSSSSSHLQLIYNLTLCELNGTDWLANKFD

SEQ ID NO: 1750 - protein, 34 aa, Porcine reproductive and respiratory syndrome virus
LVSANGNSSSHLQLIYNLTLCELNGTDWLADKFD

SEQ ID NO: 1751 - protein, 34 aa, Porcine reproductive and respiratory syndrome virus
LVNANSSNSSHLQLIYNLTLCELNGTDWLANRFD

SEQ ID NO: 1752 - protein, 34 aa, Porcine reproductive and respiratory syndrome virus; identical to SEQ ID NO: 38

SEQ ID NO: 1753 - protein, 34 aa, Porcine reproductive and respiratory syndrome virus
LVNANSNSSSHLQLIYNLTLCELNGTEWLADKFD

SEQ ID NO: 1754 - protein, 34 aa, Porcine reproductive and respiratory syndrome virus
LVNANNSTSSHLQLIYNLTLCELNGTDWLADKFD

SEQ ID NO: 1755 - protein, 34 aa, Porcine reproductive and respiratory syndrome virus
LVNANSDSSSHLQLIYNLTLCELNGTDWLAEKFD

SEQ ID NO: 1756 - protein, 34 aa, Porcine reproductive and respiratory syndrome virus; identical to SEQ ID NO: 226

SEQ ID NO: 1757 - protein, 34 aa, Porcine reproductive and respiratory syndrome virus
LVNANSNSSSHFQLIYNLTLCELNGTDWLAQKFD

SEQ ID NO: 1758 - protein, 34 aa, Porcine reproductive and respiratory syndrome virus; identical to SEQ ID NO: 655

SEQ ID NO: 1759 - protein, 34 aa, Porcine reproductive and respiratory syndrome virus; identical to SEQ ID NO: 1505

SEQ ID NO: 1760 - protein, 34 aa, Porcine reproductive and respiratory syndrome virus; identical to SEQ ID NO: 15

SEQ ID NO: 1761 - protein, 34 aa, Porcine reproductive and respiratory syndrome virus
LANASTNSSSHLQLIYNLTLCELNGTDWLANRFD

SEQ ID NO: 1762 - protein, 34 aa, Porcine reproductive and respiratory syndrome virus; identical to SEQ ID NO: 563

SEQ ID NO: 1763 - protein, 33 aa, Porcine reproductive and respiratory syndrome virus
SFVAGGSSSTYQYIYNLTICELNGTDWLSNHFD

SEQ ID NO: 1764 - protein, 34 aa, Porcine reproductive and respiratory syndrome virus; identical to SEQ ID NO: 15

SEQ ID NO: 1765 - protein, 41 aa, Porcine reproductive and respiratory syndrome virus
VPFCFVALVNASNNSSSHLQLIYNLTICELNGTDWLNKSFD

SEQ ID NO: 1766 - protein, 41 aa, Porcine reproductive and respiratory syndrome virus
VPFCFVALVNASNNSSSHLQLIYNLTICELNGTDWLNKNFD

SEQ ID NO: 1767 - protein, 41 aa, Porcine reproductive and respiratory syndrome virus; identical to SEQ ID NO: 1765

SEQ ID NO: 1768 - protein, 41 aa, Porcine reproductive and respiratory syndrome virus
VPFCFVALVNASNNSSSHLQLIYNLTICELNGTDWLDKTFD

SEQ ID NO: 1769 - protein, 41 aa, Porcine reproductive and respiratory syndrome virus
VPFCLAALVNADSNSSSHLQLIYNLTICELNGTDWLNNHFS

SEQ ID NO: 1770 - protein, 31 aa, Porcine reproductive and respiratory syndrome virus
ADSNSSSHLQLIYNLTICELNGTDWLNNRFG

SEQ ID NO: 1771 - protein, 41 aa, Porcine reproductive and respiratory syndrome virus
VPFCFAVLANASNNSSSHLQLIYNLTLCELNGTDWLANKFD

SEQ ID NO: 1772 - protein, 41 aa, Porcine reproductive and respiratory syndrome virus
VPFCLVALVNANSNNSSHLQLIYNLTICELNGTDWLNRHFS

SEQ ID NO: 1773 - protein, 41 aa, Porcine reproductive and respiratory syndrome virus
VPFCLVALVNANSNNSSHLQLIYNLTICELNGTDWLNEHFS

SEQ ID NO: 1774 - protein, 41 aa, Porcine reproductive and respiratory syndrome virus
VPFCFAALVNASNNSSSHLQLIYNLTICELNGTDWLNEHFS

SEQ ID NO: 1775 - protein, 41 aa, Porcine reproductive and respiratory syndrome virus; identical to SEQ ID NO: 1766

SEQ ID NO: 1776 - protein, 41 aa, Porcine reproductive and respiratory syndrome virus
  misc_feature (4)..(4): Xaa can be any naturally occurring amino acid
VPFXFAVIVNANNNSSSHFQLIYNLTLCELNGTEWLNKKFD

SEQ ID NO: 1777 - protein, 41 aa, Porcine reproductive and respiratory syndrome virus
VPFWFAVLVDANSNSSSHFQLIYNLTICELNGTDWLNNKFD

SEQ ID NO: 1778 - protein, 41 aa, Porcine reproductive and respiratory syndrome virus
VPSCFVAPVNANDNNSSKLQLIYNLTLCELNGTDWLAGKFD

SEQ ID NO: 1779 - protein, 41 aa, Porcine reproductive and respiratory syndrome virus
VPFCFAVIVNASNNSSSHFQLIYNLTLCELNGTDWLAEHFN

SEQ ID NO: 1780 - protein, 41 aa, Porcine reproductive and respiratory syndrome virus; identical to SEQ ID NO: 1779

SEQ ID NO: 1781 - protein, 34 aa, Porcine reproductive and respiratory syndrome virus
LANANSNSSSHLQLIYNLTICELNGTDWLNNHFS

SEQ ID NO: 1782 - protein, 34 aa, Porcine reproductive and respiratory syndrome virus
LASASNSSSSHLQLIYNLTLCELNGTDWLANKFD

SEQ ID NO: 1783 - protein, 34 aa, Porcine reproductive and respiratory syndrome virus
LATPSPSSSSHLQLIYNLTLCELNGTDWLANKFD

SEQ ID NO: 1784 - protein, 34 aa, Porcine reproductive and respiratory syndrome virus
LANASNANSSHLQLIYNLTLCELNGTDWLANKFD

SEQ ID NO: 1785 - protein, 34 aa, Porcine reproductive and respiratory syndrome virus
LANASNVNSSHLQLIYNLTLCELNGTDWLANKFD

SEQ ID NO: 1786 - protein, 34 aa, Porcine reproductive and respiratory syndrome virus
LANASNDNSSHLQLIYNLTLCELNGTDWLANKFD

SEQ ID NO: 1787 - protein, 34 aa, Porcine reproductive and respiratory syndrome virus
LANASNSNSSHLQLIYNLTLCELNGTDWLANKFD

SEQ ID NO: 1788 - protein, 34 aa, Porcine reproductive and respiratory syndrome virus
LANASNSNSSHLQLIYNLTLCELNGTDWLADKFD

SEQ ID NO: 1789 - protein, 34 aa, Porcine reproductive and respiratory syndrome virus
LANASNGNSSHLQLIYNLTLCELNGTDWLAGKFD

SEQ ID NO: 1790 - protein, 34 aa, Porcine reproductive and respiratory syndrome virus
LANASNSSNSHLQLIYNLTLCELNGTDWLAGKFD

SEQ ID NO: 1791 - protein, 34 aa, Porcine reproductive and respiratory syndrome virus
LANASNDSSSHLQLIYNLTLCELNGTDWLADKFD

SEQ ID NO: 1792 - protein, 34 aa, Porcine reproductive and respiratory syndrome virus
LANASNTSSSHLQLIYNLTLCELNGTDWLADKFD

SEQ ID NO: 1793 - protein, 34 aa, Porcine reproductive and respiratory syndrome virus
  misc_feature (28)..(28): Xaa can be any naturally occurring amino acid
LANANNTSSSHLQLIYNLTLCELNGTDXLAEKFD

SEQ ID NO: 1794 - protein, 34 aa, Porcine reproductive and respiratory syndrome virus
LANANNSSSSHLQLIYNLTLCELNGTDWLANKFD

SEQ ID NO: 1795 - protein, 34 aa, Porcine reproductive and respiratory syndrome virus
LANASSNSSSHLQLIYNLTLCELNGTDWLANKFD

SEQ ID NO: 1796 - protein, 34 aa, Porcine reproductive and respiratory syndrome virus
LANASQNSSSHLQLIYNLTLCELNGTDWLANKFD

SEQ ID NO: 1797 - protein, 34 aa, Porcine reproductive and respiratory syndrome virus
LANASSNSSSHLQLIYNLTLCELNGTDWLANRFD

SEQ ID NO: 1798 - protein, 34 aa, Porcine reproductive and respiratory syndrome virus
LANASSDNSSHLQLIYNLTLCELNGTDWLANNFD

SEQ ID NO: 1799 - protein, 34 aa, Porcine reproductive and respiratory syndrome virus
LASANSINSPHLQLIYNLTLCELNGTDWLAGEFD

SEQ ID NO: 1800 - protein, 34 aa, Porcine reproductive and respiratory syndrome virus
LASASNNSSSRLQLIYNLTLCELNGTDWLADRFN

SEQ ID NO: 1801 - protein, 34 aa, Porcine reproductive and respiratory syndrome virus
LADAHSSSSSHLQLIYNLTLCELNGTDWLADRFD

SEQ ID NO: 1802 - protein, 34 aa, Porcine reproductive and respiratory syndrome virus
LANAGNNSSSHLQLIYNLTLCELNGTEWLAERFD

SEQ ID NO: 1803 - protein, 34 aa, Porcine reproductive and respiratory syndrome virus
LGSASSNSSSHFQLIYNLTLCELNGTDWLASRFD

SEQ ID NO: 1804 - protein, 34 aa, Porcine reproductive and respiratory syndrome virus
LVDANNSSSSHFQLIYNLTICELNGTDWLKARFD

SEQ ID NO: 1805 - protein, 34 aa, Porcine reproductive and respiratory syndrome virus
LVDANNSSSSHFQLIYNLTICELNGTDWLAARFD

SEQ ID NO: 1806 - protein, 34 aa, Porcine reproductive and respiratory syndrome virus
LVDANGNSSSHLQLIYNLTLCELNGTDWLANRFD

SEQ ID NO: 1807 - protein, 34 aa, Porcine reproductive and respiratory syndrome virus
LVNANSTSSSHIQLIYNLTLCELNGTDWLGDKFD

SEQ ID NO: 1808 - protein, 34 aa, Porcine reproductive and respiratory syndrome virus
LVNANSSSSSHLQSIYNLTLCELNGTDWLGNKFD

SEQ ID NO: 1809 - protein, 34 aa, Porcine reproductive and respiratory syndrome virus
LVDANSSSSSHFQLIYNLTLCELNGTDWLNDKFD

SEQ ID NO: 1810 - protein, 34 aa, Porcine reproductive and respiratory syndrome virus
LVDANSSSSSHFQLIYNLTLCELNGTDWLNEKFD

SEQ ID NO: 1811 - protein, 34 aa, Porcine reproductive and respiratory syndrome virus
LVNANSSSSSHFQLIYNLTLCELNGTDWLNEKFD

SEQ ID NO: 1812 - protein, 34 aa, Porcine reproductive and respiratory syndrome virus
LANANSSSSSHFQLIYNLTLCELNGTDWLDKKFD

SEQ ID NO: 1813 - protein, 34 aa, Porcine reproductive and respiratory syndrome virus
LVNANSASSSHSQLIYNLTLCELNGTDWLDGKFE

SEQ ID NO: 1814 - protein, 34 aa, Porcine reproductive and respiratory syndrome virus
LVNANSASSSHSQLIYNLTLCELNGTDWLAGKFE

SEQ ID NO: 1815 - protein, 34 aa, Porcine reproductive and respiratory syndrome virus
LVNANSTSSSPFQLIYNLTLCELNGTDWLQGKFN

SEQ ID NO: 1816 - protein, 34 aa, Porcine reproductive and respiratory syndrome virus
IANASSNSSSHIQLIYNLTLCELNGTDWLAGKFD

SEQ ID NO: 1817 - protein, 34 aa, Porcine reproductive and respiratory syndrome virus
IVNANSNSSSHFQLIYNLTLCELNGTDWLANKFD

SEQ ID NO: 1818 - protein, 34 aa, Porcine reproductive and respiratory syndrome virus
VVNANSNSSSHFQSIYNLTLCELNGTKWLATKFD

SEQ ID NO: 1819 - protein, 34 aa, Porcine reproductive and respiratory syndrome virus
LDNANSTSSSHFQSIYNLTLCELNGTEWLAENFD

SEQ ID NO: 1820 - protein, 34 aa, Porcine reproductive and respiratory syndrome virus
LDNANSTSSSHFQSIYNLTLCELNGTKWLAEHFD

SEQ ID NO: 1821 - protein, 34 aa, Porcine reproductive and respiratory syndrome virus
LVNANSTSSSHFQSIYNLTLCELNGTDWLKEKFD

SEQ ID NO: 1822 - protein, 34 aa, Porcine reproductive and respiratory syndrome virus
LVDANSSSSSHFQSIYNLTLCELNGTDWLTERFD

SEQ ID NO: 1823 - protein, 34 aa, Porcine reproductive and respiratory syndrome virus
LVDANSNSSSHFQLIYNLTLCELNGPDWLKKNFD

SEQ ID NO: 1824 - protein, 34 aa, Porcine reproductive and respiratory syndrome virus
LVGANGNSSSHFQLIYNLTLCELNGTDWLDEKFD

SEQ ID NO: 1825 - protein, 34 aa, Porcine reproductive and respiratory syndrome virus
LVNASSNSSSHFQLIYNLTLCELNGTDWLKNKFD

SEQ ID NO: 1826 - protein, 34 aa, Porcine reproductive and respiratory syndrome virus
LVNAHSNSSSHFQSIYNLTLCELNGTDWLDKKFD

SEQ ID NO: 1827 - protein, 34 aa, Porcine reproductive and respiratory syndrome virus
LVNAHDNSSSHFQLIYNLTLCELNGTDWLNKKFD

SEQ ID NO: 1828 - protein, 34 aa, Porcine reproductive and respiratory syndrome virus
LVNASNTSSSYFQSIYNLTLCELNGTDWLKDKFD

SEQ ID NO: 1829 - protein, 34 aa, Porcine reproductive and respiratory syndrome virus
LVNASNSSSSHFQLIYNLTLCELNGTDWLQGKFD

SEQ ID NO: 1830 - protein, 34 aa, Porcine reproductive and respiratory syndrome virus
IVNASNSNSSHLQSIYSLTLCELNGTEWLGKNFD

SEQ ID NO: 1831 - protein, 34 aa, Porcine reproductive and respiratory syndrome virus
LVNANNSSSSHFQSIYNLTLCELNGTEWLAKNFN

SEQ ID NO: 1832 - protein, 34 aa, Porcine reproductive and respiratory syndrome virus
LVNASSNNSSHFQLIYNLTLCELNGTEWLAKNFI

SEQ ID NO: 1833 - protein, 34 aa, Porcine reproductive and respiratory syndrome virus
LVNANSNSSSHLQLIYNLTLCELNGADWLKDKFA

SEQ ID NO: 1834 - protein, 34 aa, Porcine reproductive and respiratory syndrome virus
LVNASNSNSSHLQLIYNLTLCELNGTDWLGNKFN

SEQ ID NO: 1835 - protein, 34 aa, Porcine reproductive and respiratory syndrome virus
LASANNNHSSHLQSIYNLTLCELNGTDWLSDKFD

SEQ ID NO: 1836 - protein, 34 aa, Porcine reproductive and respiratory syndrome virus
LASANGNHSSHLQSIYNLTLCELNGTDWLRSRFS

SEQ ID NO: 1837 - protein, 34 aa, Porcine reproductive and respiratory syndrome virus
LVGASNTSSSHFQLIYNLTLCELNGTDWLNNHFY

SEQ ID NO: 1838 - protein, 34 aa, Porcine reproductive and respiratory syndrome virus
IVDANSNSSSHFQLIYNLTLCELNGTDWLNNHFN

SEQ ID NO: 1839 - protein, 34 aa, Porcine reproductive and respiratory syndrome virus
PVNANNGSSSYSQLIYNLTICELNGTDWLNSKFD

SEQ ID NO: 1840 - protein, 34 aa, Porcine reproductive and respiratory syndrome virus
PVNANNGTSSYSQLIYNLTICELNGTEWLGSKFD

SEQ ID NO: 1841 - protein, 34 aa, Porcine reproductive and respiratory syndrome virus
LVNAANTSSSYSQLIYNLTLCELNGTDWLVNRFD

SEQ ID NO: 1842 - protein, 34 aa, Porcine reproductive and respiratory syndrome virus
LANANNTSSSYSQLIYNLTLCELNGTDWLVGKFE

SEQ ID NO: 1843 - protein, 34 aa, Porcine reproductive and respiratory syndrome virus
LANANSTSSSYSQLIYNLTICELNGTDWLDDNFD

SEQ ID NO: 1844 - protein, 34 aa, Porcine reproductive and respiratory syndrome virus
LVNANSSSSSYSQLIYNLTLCELNGTDWLDKKFY

SEQ ID NO: 1845 - protein, 34 aa, Porcine reproductive and respiratory syndrome virus
LVNANNTSSSYSQLIYNLTLCELNGADWLKEHFS

SEQ ID NO: 1846 - protein, 34 aa, Porcine reproductive and respiratory syndrome virus
LVNANNTNSSYSQLIYNLTLCELNGTDWLKGHFS

SEQ ID NO: 1847 - protein, 34 aa, Porcine reproductive and respiratory syndrome virus
LVNANSTSSSYSQLIYNLTLCELNGTEWLGNSFN

SEQ ID NO: 1848 - protein, 34 aa, Porcine reproductive and respiratory syndrome virus
LVNANSTSSSYSQLIYNLTLCELNGTEWLGTKFS

SEQ ID NO: 1849 - protein, 34 aa, Porcine reproductive and respiratory syndrome virus
LVNANSTSSSYSQLIYNLTLCELNGTEWLGEKFS

SEQ ID NO: 1850 - protein, 34 aa, Porcine reproductive and respiratory syndrome virus
LVNANSTNSSYSQLIYNLTLCELNGTEWLGKNFS

SEQ ID NO: 1851 - protein, 34 aa, Porcine reproductive and respiratory syndrome virus
LVNANSTNSSYSQLIYKLTLCELNGTEWLGKKFS

SEQ ID NO: 1852 - protein, 34 aa, Porcine reproductive and respiratory syndrome virus
LVNANSTSSSYSQLIYNLTLCELNGTDWLNEKFS

SEQ ID NO: 1853 - protein, 34 aa, Porcine reproductive and respiratory syndrome virus
LVNANSTSSSYSQLIYNLTLCELNGTDWLNDKFS

SEQ ID NO: 1854 - protein, 34 aa, Porcine reproductive and respiratory syndrome virus
LVNANSTSSSYSQLIYNLTLCELNGTDWLDGHFS

SEQ ID NO: 1855 - protein, 34 aa, Porcine reproductive and respiratory syndrome virus
LVNANSTSSSYSQLIYNLTICELNGTDWLNGQFS

SEQ ID NO: 1856 - protein, 34 aa, Porcine reproductive and respiratory syndrome virus
LVNANNTSSSYSQLIYNLTICELNGTDWLNGRFS

SEQ ID NO: 1857 - protein, 34 aa, Porcine reproductive and respiratory syndrome virus
LVNANNTSSSYSQLIYNLTICELNGTDWLNGKFS

SEQ ID NO: 1858 - protein, 34 aa, Porcine reproductive and respiratory syndrome virus
LVNANSTSSSYSQLIYNLTICELNGTDWLNEHFS

SEQ ID NO: 1859 - protein, 34 aa, Porcine reproductive and respiratory syndrome virus; identical to SEQ ID NO: 1858

SEQ ID NO: 1860 - protein, 34 aa, Porcine reproductive and respiratory syndrome virus
LVNASNNSSSHLQLIYNLTICELNGTDWLDKTFD

SEQ ID NO: 1861 - protein, 34 aa, Porcine reproductive and respiratory syndrome virus
LVNASNNSSSHLQLIYNLTICELNGTDWLDKSFD

SEQ ID NO: 1862 - protein, 34 aa, Porcine reproductive and respiratory syndrome virus
LVNASNNSSSHLQLIYNLTICELNGTDWLNKTFD

SEQ ID NO: 1863 - protein, 34 aa, Porcine reproductive and respiratory syndrome virus
LVNASNNSSSHLQLIYNLTICELNGTDWLNRSFD

SEQ ID NO: 1864 - protein, 34 aa, Porcine reproductive and respiratory syndrome virus
LVNASNNSSSHLQLIYNLTICELNGTDWLNESFD

SEQ ID NO: 1865 - protein, 34 aa, Porcine reproductive and respiratory syndrome virus
LVNASNNSSSHLQLIYNLTICELNGTDWLSNNFD

SEQ ID NO: 1866 - protein, 34 aa, Porcine reproductive and respiratory syndrome virus
LVNASNNGSSHLQLIYNLTICELNGTDWLNNTFD

SEQ ID NO: 1867 - protein, 34 aa, Porcine reproductive and respiratory syndrome virus
LVNASNDSSSHLQLIYNLTICELNGTDWLNGHFS

SEQ ID NO: 1868 - protein, 34 aa, Porcine reproductive and respiratory syndrome virus; identical to SEQ ID NO: 1668

SEQ ID NO: 1869 - protein, 34 aa, Porcine reproductive and respiratory syndrome virus
LVNANSNSSSNLQLIYNLTICELNGTEWLGSHFS

SEQ ID NO: 1870 - protein, 34 aa, Porcine reproductive and respiratory syndrome virus
LVNANNSSSSHTQLIYNLTLCELNGTEWLSHKFD

SEQ ID NO: 1871 - protein, 34 aa, Porcine reproductive and respiratory syndrome virus
LVNAANSSSSHFQSIYNLTLCELNGTDWLSKKFD

SEQ ID NO: 1872 - protein, 34 aa, Porcine reproductive and respiratory syndrome virus
LVNANNTSSSHFQLIYNLTLCELNGTDWLKYKFE

SEQ ID NO: 1873 - protein, 34 aa, Porcine reproductive and respiratory syndrome virus
LVDANSNSSSHFQLIYNLTICELNGTDWLYKHFD

SEQ ID NO: 1874 - protein, 33 aa, Porcine reproductive and respiratory syndrome virus
FADGNGNNSTYQYIYNLTICELNGTNWLSGHFE

SEQ ID NO: 1875 - protein, 33 aa, Porcine reproductive and respiratory syndrome virus
FADGNGNNSTYQYIYNLTICELNGTNWLSDHFE

SEQ ID NO: 1876 - protein, 33 aa, Porcine reproductive and respiratory syndrome virus
FADGNDNNSTYQYIYNLTICELNGTNWLSAHFE

SEQ ID NO: 1877 - protein, 33 aa, Porcine reproductive and respiratory syndrome virus
FADGNGNNSTYQYIYNLTICELNGTDWLSAHFE

SEQ ID NO: 1878 - protein, 33 aa, Porcine reproductive and respiratory syndrome virus
FADGNGNDSTYQYIYDLTICELNGTHWLSNHFV

SEQ ID NO: 1879 - protein, 33 aa, Porcine reproductive and respiratory syndrome virus
FADGNGNDSTYQYIYNLTICELNGTSWLSDHFE

SEQ ID NO: 1880 - protein, 33 aa, Porcine reproductive and respiratory syndrome virus
FADGSGNNSTYQYIYNLTICELNGTDWLSGHFN

SEQ ID NO: 1881 - protein, 33 aa, Porcine reproductive and respiratory syndrome virus
FADGSGNNSTYQYIYNLTICELNGTKWLSGHFD

SEQ ID NO: 1882 - protein, 33 aa, Porcine reproductive and respiratory syndrome virus
FADGNGNSSTYQYIYNLTICELNGTTWLSGHFN

SEQ ID NO: 1883 - protein, 33 aa, Porcine reproductive and respiratory syndrome virus
FADGNGNSSTYQYIYNLTICELNGTNWLSGHFN

SEQ ID NO: 1884 - protein, 33 aa, Porcine reproductive and respiratory syndrome virus
FADGNGNNSTYQYIYNLTICELNGTDWLSNHFS

SEQ ID NO: 1885 - protein, 33 aa, Porcine reproductive and respiratory syndrome virus
FADGNDNNSTYQYIYNLTICELNGTNWLSNHFS

SEQ ID NO: 1886 - protein, 33 aa, Porcine reproductive and respiratory syndrome virus
FADGNGDSSTYQYIYNLTICELNGTDWLSSHFG

SEQ ID NO: 1887 - protein, 33 aa, Porcine reproductive and respiratory syndrome virus; identical to SEQ ID NO: 1886

What is claimed is:

1. A method of producing an immune response in a subject, said method comprising administering a composition comprising at least a first and a second antigenic domain, each domain comprising a variable HV-1 region of about 13 amino acids and a conserved GP5 motif, represented by the sequence C(E/S)LNG(T/A), SEQ ID NO:1, chemically linked to an HV-2 hypervariable region comprising about eight amino acid residues, and wherein said first and second antigenic domains contain different HV-2 hypervariable regions to said subject to produce an immune response in said subject against said antigenic domains.

2. The method of claim 1, wherein said subject is a pig.

3. The method of claim 1, wherein said composition comprises a first polypeptide molecule containing said first antigenic domain and a second polypeptide molecule containing said second antigenic domain.

4. The method of claim 3, wherein at least one of said first and second antigenic domains comprises an HV-2 hypervariable region represented by the sequence $X_0WLX_1X_2X_3X_4X_5$, wherein each of $X_0$, $X_1$, $X_2$, $X_3$, $X_4$, and $X_5$ is independently one of the 20 naturally occurring amino acid residues, except that $X_5$ is not cysteine, methionine, proline, phenylalanine, or tryptophan.

5. The method of claim 4, wherein said HV-2 region is represented by the sequence $X_0WLX_1X_2X_3X_4X_5$ wherein $X_5$ is not cysteine, methionine, proline, phenylalanine, tryptophan, serine, threonine, or tyrosine, and represented by D-1: wherein $X_1$ is an aliphatic amino acid residue, $X_2$ is an acidic amino acid residue (or wherein $X_1$ is an acidic amino acid residue and $X_2$ is an aliphatic amino acid residue), $X_3$ is a basic amino acid residue, and $X_4$ is an amino acid residue comprising an aromatic ring, such as phenylalanine (F);

D-2: wherein $X_1$ is an aliphatic amino acid residue, $X_2$ is serine (S), threonine (T), tyrosine (Y) or an basic amino acid residue (or wherein $X_1$ is serine (S), threonine (T), tyrosine (Y) or a basic amino acid residue and $X_2$ is an aliphatic amino acid residue), $X_3$ is a basic amino acid residue, and $X_4$ is an amino acid residue comprising an aromatic ring, such as phenylalanine (F);

D-3: wherein each of $X_1$ and $X_2$ is independently an aliphatic amino acid residue, $X_3$ is a basic amino acid residue, and $X_4$ is an amino acid residue comprising an aromatic ring, such as phenylalanine (F);

D-4: wherein $X_1$ is an acidic amino acid residue, $X_2$ is serine (S), threonine (T), tyrosine (Y) or a basic amino acid residue (or wherein $X_1$ is serine (S), threonine (T), tyrosine (Y) or a basic amino acid residue and $X_2$ is an acidic amino acid residue), $X_3$ is a basic amino acid residue, and $X_4$ is an amino acid residue comprising an aromatic ring, such as phenylalanine (F);

D-5: wherein each of $X_1$ and $X_2$ is independently an acidic amino acid residue, $X_3$ is a basic amino acid residue, and $X_4$ is an amino acid residue comprising an aromatic ring, such as phenylalanine (F);

D-6: wherein each of $X_1$ and $X_2$ is independently one of the 20 naturally occurring amino acid residues, $X_3$ is an acidic amino acid residue, and $X_4$ is an amino acid residue comprising an aromatic ring, such as phenylalanine (F);

D-7: wherein each of $X_1$ and $X_2$ is independently one of the 20 naturally occurring amino acid residues, $X_3$ is a non-aromatic amino acid residue with a hydroxyl containing R-group, and $X_4$ is an amino acid residue comprising an aromatic ring, such as phenylalanine (F); or D-8: wherein each of $X_1$ and $X_2$ is independently serine (S), threonine (T), tyrosine (Y) or a basic amino acid residue, $X_3$ is a basic amino acid residue, and $X_4$ is an amino acid residue comprising an aromatic ring, such as phenylalanine (F).

6. The method of claim 4, wherein said HV-2 region is represented by the sequence $X_0WLX_1X_2X_3X_4X_5$ and represented by S-1: wherein $X_1$ is an acidic amino acid residue, $X_2$ is asparagine (N), $X_3$ is a basic amino acid residue, $X_4$ is an amino acid residue comprising an aromatic ring, such as phenylalanine (F), and $X_5$ is serine (S);

S-2: wherein each of $X_1$ and $X_2$ is independently an acidic amino acid residue except that $X_2$ is not asparagine (N), $X_3$ is a basic amino acid residue, $X_4$ is an amino acid residue comprising an aromatic ring, such as phenylalanine (F), and $X_5$ is serine (S);

S-3: wherein $X_1$ is an aliphatic amino acid residue, $X_2$ is an acidic amino acid residue (or wherein $X_1$ is an acidic amino acid residue and $X_2$ is an aliphatic amino acid residue), $X_3$ is a basic amino acid residue, $X_4$ is an amino acid residue comprising an aromatic ring, such as phenylalanine (F), and $X_5$ is serine (S);

S-4: wherein $X_1$ is an aliphatic amino acid residue, $X_2$ is serine (S), threonine (T), tyrosine (Y) or a basic amino acid residue (or wherein $X_1$ is serine (S), threonine (T), tyrosine (Y) or a basic amino acid residue and $X_2$ is an aliphatic amino acid residue; or where each of $X_1$ and $X_2$ is independently serine (S), threonine (T), tyrosine (Y) or a basic amino acid residue; or where each of $X_1$ and $X_2$ is independently an aliphatic amino acid residue), $X_3$ is a basic amino acid residue, $X_4$ is an amino acid residue comprising an aromatic ring, such as phenylalanine (F), and $X_5$ is serine (S);

S-5: wherein $X_1$ is an acidic amino acid residue, $X_2$ is serine (S), threonine (T), tyrosine (Y) or a basic amino acid residue (or wherein $X_1$ is serine (S), threonine (T), tyrosine (Y) or a basic amino acid residue and $X_2$ is an acidic amino acid residue except N (Asn)), $X_3$ is a basic amino acid residue, $X_4$ is an amino acid residue comprising an aromatic ring, such as phenylalanine (F), and $X_5$ is serine (S);

S-6: wherein $X_1$ is serine (S), threonine (T), tyrosine (Y) or a basic amino acid residue, $X_2$ is an asparagine (N), $X_3$ is a basic amino acid residue, $X_4$ is an amino acid residue comprising an aromatic ring, such as phenylalanine (F), and $X_5$ is serine (S);

S-7: wherein each of $X_1$ and $X_2$ is independently one of the 20 naturally occurring amino acid residues, $X_3$ is a basic amino acid residue, $X_4$ is an amino acid residue comprising an aromatic ring, such as phenylalanine (F), and $X_5$ is threonine (T) or tyrosine (Y); or S-8: wherein $X_1$ is an acidic amino acid residue, $X_2$ is an acidic amino acid residue (or wherein $X_1$ is an acidic amino acid residue and, $X_2$ is an aliphatic amino acid residue, or alternatively wherein $X_1$ is an aliphatic amino acid residue and, $X_2$ is an acidic amino acid residue), $X_3$ is an acidic amino acid residue, $X_4$ is an amino acid residue comprising an aromatic ring, such as phenylalanine (F), and $X_5$ is serine (S).

7. The method of claim 3, wherein at least one of said first and second antigenic domains comprises an HV-2 hypervariable region represented by the sequence $NWLSX_2X_3X_4X_5$ (represented by E-1), wherein each of $X_2$, $X_3$, and $X_4$ is independently one of the 20 naturally occurring amino acid residues, and $X_5$ is an acidic amino acid residue;

the sequence $X_0WLX_1X_2X_3X_4X_5$ (represented by E-2), wherein $X_0$ is an acidic amino acid residue except for asparagine (N), each of $X_1$, $X_2$, $X_3$, and $X_4$ is independently one of the 20 naturally occurring amino acid residues, and $X_5$ is an acidic amino acid residue;

the sequence $X_0WLX_1X_2X_3X_4X_5$ (represented by E-3), wherein $X_0$ is a basic amino acid residue, each of $X_1$, $X_2$, $X_3$, and $X_4$ is independently one of the 20 naturally occurring amino acid residues, and $X_5$ is an acidic amino acid residue;

the sequence $X_0WLX_1X_2X_3X_4X_5$ (represented by E-4), wherein $X_0$ is any non-acidic and non-basic amino acid residue, each of $X_1$, $X_2$, $X_3$, and $X_4$ is independently one of the 20 naturally occurring amino acid residues, and $X_5$ is an acidic amino acid residue;

the sequence $NWLSX_2X_3X_4X_5$ (represented by E-5), wherein each of $X_2$, $X_3$ and $X_4$ is independently one of the 20 naturally occurring amino acid residues, and $X_5$ is Serine (S) or Threonine (T);

the sequence $X_0WLX_1NX_3X_4X_5$ (represented by E-6), wherein $X_0$ is any amino acid residue except asparagine (N), each of $X_1$, $X_3$, and $X_4$ is independently one of the 20 naturally occurring amino acid residues, and $X_5$ is Serine (S) or Threonine (T);

the sequence $X_0WLX_1X_2X_3X_4X_5$ (represented by E-7), wherein $X_0$ is an acidic amino acid residue except asparagine (N), each of $X_1$, $X_2$, $X_3$, and $X_4$ is independently one of the 20 naturally occurring amino acid residues except that $X_2$ is not asparagine (N), and $X_5$ is any non-acidic amino acid residue; or the sequence $X_0WLX_1X_2X_3X_4X_5$ (represented by E-8), wherein $X_0$ is any non-acidic amino acid residue, each of $X_1$, $X_2$, $X_3$, and $X_4$ is independently one of the 20 naturally occurring amino acid residues, and $X_5$ is any non-acidic amino acid residue.

8. The method of claim 3, wherein each of said first and second polypeptides comprises a GP5 transmembrane domain.

9. The method of claim 3, wherein at least one of said first and second polypeptides is membrane bound or membrane associated.

10. The method of claim 3, wherein at least one of said first and second polypeptides is associated with a PRRSV viral particle.

11. The method of claim 10, wherein said viral particle is a virion.

12. The method of claim 11, wherein said composition comprises from two to four PRRSV isolates, two of which comprise said first and second domains.

13. The method of claim 3, further comprising one or more additional polypeptides comprising a conserved GP5 motif covalently linked to an HV-2 hypervariable region wherein said one or more additional polypeptides contains a HV-2 hypervariable region different from said first and second polypeptides.

14. The method of claim 3, wherein said first polypeptide molecule comprises an HV-2 region selected from D-1, D-2, D-3, D-4, D-5, D-6, D-7, and D-8, and said second polypeptide molecule comprises an HV-2 region selected from S-1, S-2, S-3, S-4, S-5, S-6, S-7, and S-8.

15. The method of claim 14, further comprising a third isolate, wherein said third isolate comprises an HV-2 region selected from E-1, E-2, E-3, E-4, E-5, E-6, E-7, and E-8.

16. The method of claim 3, wherein said first polypeptide molecule comprises an HV-2 region selected from D-1, D-2, D-3, D-4, D-5, D-6, D-7, and D-8, and said second polypeptide molecule comprises an HV-2 region selected from E-1, E-2, E-3, E-4, E-5, E-6, E-7, and E-8.

17. The method of claim 3, wherein said first polypeptide molecule comprises an HV-2 region selected from S-1, S-2, S-3, S-4, S-5, S-6, S-7, and S-8, and said second polypeptide molecule comprises an HV-2 region selected from E-1, E-2, E-3, E-4, E-5, E-6, E-7, and E-8.

18. A method of producing an immune response in a subject, said method comprising at least identifying or selecting a first PRRSV isolate comprising a polypeptide molecule containing a first HV-2 hypervariable region, identifying or selecting a second PRRSV isolate comprising a polypeptide molecule containing a second HV-2 hypervariable region different from said first hypervariable region, and administering said first and second isolates to said subject to produce an immune response in said subject.

19. The method of claim 18, wherein said selecting comprises amino acid sequence analysis of the PRRSV GP5 ectodomain HV-2 hypervariable region;

PCR-based or antibody-based detection of the PRRSV GP5 ectodomain HV-2 hypervariable region; or knowing the PRRSV GP5 ectodomain HV-2 hypervariable region sequence status relative to another isolate.

20. The method of claim 18, wherein said first isolate comprises an HV-2 hypervariable region represented by the sequence $X_0WLX_1X_2X_3X_4X_5$, wherein each of $X_0$, $X_1$, $X_2$, $X_3$, $X_4$, and $X_5$ is independently one of the 20 naturally occurring amino acid residues, except that $X_5$ is not cysteine, methionine, proline, phenylalanine, or tryptophan.

21. The method of claim 20, wherein said HV-2 region is represented by the sequence $X_0WLX_1X_2X_3X_4X_5$ wherein $X_5$ is not cysteine, methionine, proline, phenylalanine, tryptophan, serine, threonine, or tyrosine, and represented by D-1: wherein $X_1$ is an aliphatic amino acid residue, $X_2$ is an acidic amino acid residue (or wherein $X_1$ is an acidic amino acid residue and $X_2$ is an aliphatic amino acid residue), $X_3$ is a basic amino acid residue, and $X_4$ is an amino acid residue comprising an aromatic ring, such as phenylalanine (F);

D-2: wherein $X_1$ is an aliphatic amino acid residue, $X_2$ is serine (S), threonine (T), tyrosine (Y) or an basic amino acid residue (or wherein $X_1$ is serine (S), threonine (T), tyrosine (Y) or a basic amino acid residue and $X_2$ is an aliphatic amino acid residue), $X_3$ is a basic amino acid residue, and $X_4$ is an amino acid residue comprising an aromatic ring, such as phenylalanine (F);

D-3: wherein each of $X_1$ and $X_2$ is independently an aliphatic amino acid residue, $X_3$ is a basic amino acid residue, and $X_4$ is an amino acid residue comprising an aromatic ring, such as phenylalanine (F);

D-4: wherein $X_1$ is an acidic amino acid residue, $X_2$ is serine (S), threonine (T), tyrosine (Y) or a basic amino acid residue (or wherein $X_1$ is serine (S), threonine (T), tyrosine (Y) or a basic amino acid residue and $X_2$ is an acidic amino acid residue), $X_3$ is a basic amino acid residue, and $X_4$ is an amino acid residue comprising an aromatic ring, such as phenylalanine (F);

D-5: wherein each of $X_1$ and $X_2$ is independently an acidic amino acid residue, $X_3$ is a basic amino acid residue, and $X_4$ is an amino acid residue comprising an aromatic ring, such as phenylalanine (F);

D-6: wherein each of $X_1$ and $X_2$ is independently one of the 20 naturally occurring amino acid residues, $X_3$ is an acidic amino acid residue, and $X_4$ is an amino acid residue comprising an aromatic ring, such as phenylalanine (F);

D-7: wherein each of $X_1$ and $X_2$ is independently one of the 20 naturally occurring amino acid residues, $X_3$ is a non-aromatic amino acid residue with a hydroxyl containing R-group, and $X_4$ is an amino acid residue comprising an aromatic ring, such as phenylalanine (F); or D-8: wherein each of $X_1$ and $X_2$ is independently serine (S), threonine (T), tyrosine (Y) or a basic amino acid residue, $X_3$ is a basic amino acid residue, and $X_4$ is an amino acid residue comprising an aromatic ring, such as phenylalanine (F).

22. The method of claim 20, wherein said HV-2 region is represented by the sequence $X_0WLX_1X_2X_3X_4X_5$ and represented by S-1: wherein $X_1$ is an acidic amino acid residue, $X_2$ is asparagine (N), $X_3$ is a basic amino acid residue, $X_4$ is an amino acid residue comprising an aromatic ring, such as phenylalanine (F), and $X_5$ is serine (S);

S-2: wherein each of $X_1$ and $X_2$ is independently an acidic amino acid residue except that $X_2$ is not asparagine (N), $X_3$ is a basic amino acid residue, $X_4$ is an amino acid residue comprising an aromatic ring, such as phenylalanine (F), and $X_5$ is serine (S);

S-3: wherein $X_1$ is an aliphatic amino acid residue, $X_2$ is an acidic amino acid residue (or wherein $X_1$ is an acidic amino acid residue and $X_2$ is an aliphatic amino acid residue), $X_3$ is a basic amino acid residue, $X_4$ is an amino acid residue comprising an aromatic ring, such as phenylalanine (F), and $X_5$ is serine (S);

S-4: wherein $X_1$ is an aliphatic amino acid residue, $X_2$ is serine (S), threonine (T), tyrosine (Y) or a basic amino acid residue (or wherein $X_1$ is serine (S), threonine (T), tyrosine (Y) or a basic amino acid residue and $X_2$ is an aliphatic amino acid residue; or where each of $X_1$ and $X_2$ is independently serine (S), threonine (T), tyrosine (Y) or a basic amino acid residue; or where each of $X_1$ and $X_2$ is independently an aliphatic amino acid residue), $X_3$ is a basic amino acid residue, $X_4$ is an amino acid residue comprising an aromatic ring, such as phenylalanine (F), and $X_5$ is serine (S);

S-5: wherein $X_1$ is an acidic amino acid residue, $X_2$ is serine (S), threonine (T), tyrosine (Y) or a basic amino acid residue (or wherein $X_1$ is serine (S), threonine (T), tyrosine (Y) or a basic amino acid residue and $X_2$ is an acidic amino acid residue except N (Asn)), $X_3$ is a basic amino acid residue, $X_4$ is an amino acid residue comprising an aromatic ring, such as phenylalanine (F), and $X_5$ is serine (S);

S-6: wherein $X_1$ is serine (S), threonine (T), tyrosine (Y) or a basic amino acid residue, $X_2$ is an asparagine (N), $X_3$ is a basic amino acid residue, $X_4$ is an amino acid residue comprising an aromatic ring, such as phenylalanine (F), and $X_5$ is serine (S);

S-7: wherein each of $X_1$ and $X_2$ is independently one of the 20 naturally occurring amino acid residues, $X_3$ is a basic amino acid residue, $X_4$ is an amino acid residue comprising an aromatic ring, such as phenylalanine (F), and $X_5$ is threonine (T) or tyrosine (Y); or S-8: wherein $X_1$ is an acidic amino acid residue, $X_2$ is an acidic amino acid residue (or wherein $X_1$ is an acidic amino acid residue and, $X_2$ is an aliphatic amino acid residue, or alternatively wherein $X_1$ is an aliphatic amino acid residue and, $X_2$ is an acidic amino acid residue), $X_3$ is an acidic amino acid residue, $X_4$ is an amino acid residue comprising an aromatic ring, such as phenylalanine (F), and $X_5$ is serine (S).

23. The method of claim 18, wherein said first isolate comprises an HV-2 hypervariable region represented by the sequence $NWLSX_2X_3X_4X_5$ (represented by E-1), wherein each of $X_2$, $X_3$, and $X_4$ is independently one of the 20 naturally occurring amino acid residues, and $X_5$ is an acidic amino acid residue;

the sequence $X_0WLX_1X_2X_3X_4X_5$ (represented by E-2), wherein $X_0$ is an acidic amino acid residue except for asparagine (N), each of $X_1$, $X_2$, $X_3$, and $X_4$ is independently one of the 20 naturally occurring amino acid residues, and $X_5$ is an acidic amino acid residue;

the sequence $X_0WLX_1X_2X_3X_4X_5$ (represented by E-3), wherein $X_0$ is a basic amino acid residue, each of $X_1$, $X_2$, $X_3$, and $X_4$ is independently one of the 20 naturally occurring amino acid residues, and $X_5$ is an acidic amino acid residue;

the sequence $X_0WLX_1X_2X_3X_4X_5$ (represented by E-4), wherein $X_0$ is any non-acidic and non-basic amino acid residue, each of $X_1$, $X_2$, $X_3$, and $X_4$ is independently one of the 20 naturally occurring amino acid residues, and $X_5$ is an acidic amino acid residue;

the sequence $NWLSX_2X_3X_4X_5$ (represented by E-5), wherein each of $X_2$, $X_3$ and $X_4$ is independently one of the 20 naturally occurring amino acid residues, and $X_5$ is Serine (S) or Threonine (T);

the sequence $X_0WLX_1NX_3X_4X_5$ (represented by E-6), wherein $X_0$ is any amino acid residue except asparagine (N), each of $X_1$, $X_3$, and $X_4$ is independently one of the 20 naturally occurring amino acid residues, and $X_5$ is Serine (S) or Threonine (T);

the sequence $X_0WLX_1X_2X_3X_4X_5$ (represented by E-7), wherein $X_0$ is an acidic amino acid residue except asparagine (N), each of $X_1$, $X_2$, $X_3$, and $X_4$ is independently one of the 20 naturally occurring amino acid residues except that $X_2$ is not asparagine (N), and $X_5$ is any non-acidic amino acid residue; or the sequence $X_0WLX_1X_2X_3X_4X_5$ (represented by E-8), wherein $X_0$ is any non-acidic amino acid residue, each of $X_1$, $X_2$, $X_3$, and $X_4$ is independently one of the 20 naturally occurring amino acid residues, and $X_5$ is any non-acidic amino acid residue.

24. The method of claim 18, wherein said first isolate comprises an HV-2 region selected from D-1, D-2, D-3, D-4, D-5, D-6, D-7, and D-8, and said second isolate comprises an HV-2 region selected from S-1, S-2, S-3, S-4, S-5, S-6, S-7, and S-8.

25. The method of claim 24, further comprising a third isolate, wherein said third isolate comprises an HV-2 region selected from E-1, E-2, E-3, E-4, E-5, E-6, E-7, and E-8.

26. The method of claim 18, wherein said first isolate comprises an HV-2 region selected from D-1, D-2, D-3, D-4, D-5, D-6, D-7, and D-8, and said second isolate comprises an HV-2 region selected from E-1, E-2, E-3, E-4, E-5, E-6, E-7, and E-8.

27. The method of claim 18, wherein said first isolate comprises an HV-2 region selected from S-1, S-2, S-3, S-4, S-5, S-6, S-7, and S-8, and said second isolate comprises an HV-2 region selected from E-1, E-2, E-3, E-4, E-5, E-6, E-7, and E-8.

28. The method of claim 18, wherein said subject is a pig.

29. The method of claim 18, wherein the polypeptide of the first PRRSV isolate and the polypeptide of said second PRRSV isolate each comprises a GP5 transmembrane domain.

30. The method of claim 18, wherein either the polypeptide of said first PRRSV isolate or the second PRRSV isolate is membrane bound or membrane associated.

31. The method of claim 18, wherein either the first PRRSV isolate or the second PRRSV isolate is a viral particle.

32. The method of claim 31, wherein said viral particle is a virion.

33. The method of claim 18, wherein said first PRRSV isolate comprises a polypeptide comprising a variable HV-1 region of about 13 amino acids and a conserved GP5 motif, represented by the sequence C(E/S)LNG(T/A), SEQ ID NO:1, chemically linked to said first HV-2 hypervariable region and said first HV-2 hypervariable region comprises about eight amino acid residues, and said second PRRSV isolate comprises a polypeptide comprising a variable HV-1 region of about 13 amino acids and a conserved GP5 motif, represented by the sequence C(E/S)LNG(T/A), SEQ ID NO:1, chemically linked to said second HV-2 hypervariable region and said second HV-2 hypervariable region comprises about eight amino acid residues.

34. The method of claim 33, wherein said administering further comprises from one to two additional PRRSV isolates, for a total comprising three to four PRRSV isolates administered.

35. The method of claim 18, wherein said administering further comprises one or more additional PRRSV isolates, each isolate comprising a polypeptide molecule comprising a conserved GP5 motif covalently linked to an HV-2 hypervariable region, and wherein each administered isolate comprises a polypeptide molecule containing an HV-2 hypervariable region different from that of the other administered isolates.

36. The method of claim 18, wherein said first and second isolates are administered sequentially, with a time interval between administrations.

37. The method of claim 36, wherein said time interval is one day or longer.

38. A method of producing an immune response in a subject, said method comprising identifying a pig as infected with a first PRRSV isolate comprising a polypeptide molecule containing a first HV-2 hypervariable region, identifying or selecting a second PRRSV isolate comprising a polypeptide molecule containing a second HV-2 hypervariable region different from said first HV-2 hypervariable region, and administering said second isolates to said pig to produce an immune response in said subject.

* * * * *